US008487160B2

(12) United States Patent
Frankard et al.

(10) Patent No.: US 8,487,160 B2
(45) Date of Patent: Jul. 16, 2013

(54) PLANTS HAVING IMPROVED GROWTH CHARACTERISTICS AND METHODS FOR MAKING THE SAME

(75) Inventors: Valerie Frankard, Waterloo (BE); Christophe Reuzeau, Tocane (FR); Ana Isabel Sanz Molinero, Gentbrugge (BE); Christian Dammann, Durham, NC (US)

(73) Assignee: CropDesign N.V., Zwijnaarde (BE)

( * ) Notice: Subject to any disclaimer, the term of this patent is extended or adjusted under 35 U.S.C. 154(b) by 1178 days.

(21) Appl. No.: 12/095,512

(22) PCT Filed: Nov. 29, 2006

(86) PCT No.: PCT/US2006/045721
§ 371 (c)(1),
(2), (4) Date: Sep. 17, 2008

(87) PCT Pub. No.: WO2007/064724
PCT Pub. Date: Jun. 7, 2007

(65) Prior Publication Data
US 2009/0070894 A1    Mar. 12, 2009

Related U.S. Application Data

(60) Provisional application No. 60/742,352, filed on Dec. 5, 2005, provisional application No. 60/748,903, filed on Dec. 8, 2005, provisional application No. 60/749,219, filed on Dec. 9, 2005, provisional application No. 60/750,143, filed on Dec. 14, 2005, provisional application No. 60/753,650, filed on Dec. 23, 2005, provisional application No. 60/756,042, filed on Jan. 4, 2006, provisional application No. 60/756,086, filed on Jan. 4, 2006.

(30) Foreign Application Priority Data

| Dec. 1, 2005 | (EP) | 05111597 |
|---|---|---|
| Dec. 5, 2005 | (EP) | 05111691 |
| Dec. 7, 2005 | (EP) | 05111786 |
| Dec. 12, 2005 | (EP) | 05111996 |
| Dec. 21, 2005 | (EP) | 05112562 |
| Dec. 30, 2005 | (EP) | 05113110 |
| Dec. 30, 2005 | (EP) | 05113111 |

(51) Int. Cl.
*A01H 5/00* (2006.01)
*A01H 5/10* (2006.01)
*C12N 15/29* (2006.01)
*C12N 15/82* (2006.01)

(52) U.S. Cl.
USPC ......... 800/290; 800/298; 530/370; 435/468; 435/419; 435/320.1

(58) Field of Classification Search
None
See application file for complete search history.

(56) References Cited

U.S. PATENT DOCUMENTS

| 6,545,200 | B1 | 4/2003 | Cahoon et al. | |
|---|---|---|---|---|
| 7,790,956 | B2 * | 9/2010 | Dudits et al. | 800/290 |
| 2004/0019926 | A1 | 1/2004 | Frankard et al. | |
| 2004/0034888 | A1 * | 2/2004 | Liu et al. | 800/289 |
| 2004/0060079 | A1 | 3/2004 | Tanaka et al. | |
| 2004/0123340 | A1 | 6/2004 | Deikman et al. | |
| 2004/0123343 | A1 * | 6/2004 | La Rosa et al. | 800/278 |
| 2005/0108793 | A1 | 5/2005 | Hu et al. | |
| 2005/0114925 | A1 * | 5/2005 | Kisaka et al. | 800/287 |
| 2006/0123505 | A1 | 6/2006 | Kikuchi et al. | |

FOREIGN PATENT DOCUMENTS

| EP | 1033405 A2 | 9/2000 |
|---|---|---|
| JP | 2005185101 | 7/2005 |
| WO | WO-97/35986 A1 | 10/1997 |
| WO | WO-98/59039 A1 | 12/1998 |
| WO | WO-00/04761 A1 | 2/2000 |
| WO | WO-00/47715 A2 | 8/2000 |
| WO | WO-00/69883 A1 | 11/2000 |
| WO | WO 01/02430 * | 1/2001 |
| WO | WO-01/02430 A2 | 1/2001 |
| WO | WO-01/49852 A1 | 7/2001 |
| WO | WO-01/70987 A2 | 9/2001 |
| WO | WO-02/28893 A2 | 4/2002 |
| WO | WO 02/38599 * | 5/2002 |
| WO | WO-02/38599 A2 | 5/2002 |
| WO | WO 02/079403 * | 10/2002 |
| WO | WO-02/079403 A2 | 10/2002 |
| WO | WO-03/008540 A2 | 1/2003 |
| WO | WO-03/014327 A2 | 2/2003 |
| WO | WO-2005/007829 A2 | 1/2005 |
| WO | WO-2005/030966 A2 | 4/2005 |
| WO | WO-2005/111216 A2 | 11/2005 |
| WO | WO-2007/138070 A2 | 12/2007 |

OTHER PUBLICATIONS

Friedberg (Brief. Bioinformatics (2006) 7: 225-242).*

(Continued)

*Primary Examiner* — Brent T Page
*Assistant Examiner* — Lee A Visone
(74) *Attorney, Agent, or Firm* — Novak Druce Connolly Bove + Quigg LLP

(57) ABSTRACT

The present invention relates generally to the field of molecular biology and concerns a method for increasing plant yield relative to suitable control plants. More specifically, the present invention concerns a method for increasing plant yield comprising increasing expression in a plant of a nucleic acid encoding a Dof (DNA-binding with one finger) domain transcription factor polypeptide. The present invention also concerns plants having increased expression of a nucleic acid encoding a Dof domain transcription factor polypeptide, which plants have increased yield relative to suitable control plants. The invention also provides constructs useful in the methods of the invention.

25 Claims, 124 Drawing Sheets

OTHER PUBLICATIONS de Pater et al (The Plant Journal 1992, 2(6) 837-844).*
Paxson et al (Plant Physiology, Dec. 2001, vol. 127, pp. 1739-1749).*
Werck-Reichhart, D., et al., "Cytochromes P450: A Success Story", Genome Biology, 2000, vol. 1, No. 6, pp. 1-9.
Hu, Y., et al., "The *Arabidopsis* Auxin-Inducible Gene *ARGOS* Controls Lateral Organ Size", The Plant Cell, vol. 15, No. 9, (2003), pp. 1951-1961.
Buell, C., et al., "*Oryza sativa (japonica* cultivar-group) chromosome 11 clone OSJNBa0095K08, complete sequence", Database EMBL, Accession No. AC137924, Dec. 11, 2002.
Han, B., et al., "*Oryza sativa* genomic DNA, chromosome 4, BAC clone: OSJNBa0058G03", EMBL Database, Accession No. AL731606, May 4, 2002.
Bommert, P., et al., "*thick tassel dwarf1* encodes a putative maize ortholog of the *Arabidopsis CLAVATA1* leucine-rich Repeat Receptor-like Kinase", Development, vol. 132, No. 6, (2005), pp. 1235-1245.
Choe, S, et al., "Overexpression of *DWARF4* in the Brassinosteroid Biosynthetic Pathway Results in Increased Vegetative Growth and Seed Yield in *Arabidopsis*", The Plant Journal, vol. 26, No., 6, (2001), pp. 573-582.
Paxson-Sowders, D.M., et al., "DEX1, a Novel Plant Protein, Is Required for Exine Pattern Formation during Pollen Development in *Arabidopsis*", Plant Physiology, vol. 127, (2001), pp. 1739-1749.
"*Arabidopsis thaliana* cDNA clone: APZ34b10_f, 3' end", EBI Database, Accession No. AV441214, Apr. 9, 2000.
White, J.A., et al., "A New Set of *Arabidopsis* Expressed Sequence Tags from Developing Seeds. The Metabolic Pathway from Carbohydrates to Seed Oil", Plant Physiology, vol. 124, (2000), pp. 1582-1594.
"M73G02STM *Arabidopsis* developing seed *Arabidopsis thaliana* cDNA clone 600036204R1 5', mRNA sequence", EBI Database, Accession Nol: BG459449, Mar. 22, 2001.
"F16N16TR IGF *Arabidopsis thaliana* genomic clone F16N16, genomic survey sequence", EBI Database, Accession No. B23736, Oct. 13, 1997.
Choe, S., et al., "The *DWF4* Gene of *Arabidopsis* Encodes a Cytochrome P450 That Mediates Multiple 22alpha-Hydroxylation Steps in Brassinosteroid Biosynthesis", The Plant Cell, vol. 10, (1998), pp. 231-243.

"*Oryza sativa japonica* Group OsDWARF4 mRNA for cytochrome P450, complete sequence", EBI Database, Accession No. AB206579, Mar. 10, 2005.
Nelson, D. R., et al., "Comparative Genomics of Rice and *Arabidopsis*. Analysis of 727 Cytochrome P450 Genes and Pseudogenes from a Monocot and a Dicot", Plant Physiology, vol. 135, (2004), pp. 756-772.
Blilou I., et al., "The *Arabidopsis* HOBBIT Gene Encodes a CDC27 Homolog that Links the Plant Cell Cycle to Progression of Cell Differentiation", Genes & Development, vol. 16, No. 19, (2002), pp. 2566-2575.
Heichman, K.A., et al., "The Yeast *CDC16* and *CDC27* Genes Restrict DNA Replication to Once per Cell Cycle", Cell, vol. 85, (1996), pp. 39-48.
Bermudez, V. P., et al., "The Influence of the Cdc27 Subunit on the Properties of the *Schizosaccharomyces pombe* DNA Polymerase delta", The Journal of Biological Chemistry, vol. 277, No. 30, (2002), pp. 36853-36862.
Gupta, R., et al., "Chromosomal Location and Expression of the Single-Copy Gene Encoding High-mobility-group Protein HMG-I/Y in *Arabidopsis thaliana*", Plant Molecular Biology, vol. 34, (1997), pp. 529-536.
Meijer, A.H., "Novel Members of a Family of AT Hook-containing DNA-binding Proteins from Rice are Identified through their in vitro Interaction with Consensus Target Sites of Plant and Animal Homeodomain Proteins", Plant Molecular Biology, vol. 31, No. 3, (1996), pp. 607-618.
Kang, H.-G., et al., "Characterization of Salicylic Acid-Responsive, *Arabidopsis* Dof Domain Proteins: Overexpression of OBP3 Leads to Growth Defects", The Plant Journal, vol. 21, No. 4, (2000), pp. 329-339.
D'Andrea, L.D., et al., "TPR Proteins: The Versatile Helix", TRENDS in Biochemical Sciences, vol. 28, No. 12, (2003), pp. 655-662.
Klosterman, S.J., et al., "Plant HMG Proteins Bearing the AT-hook Motif", Plant Science, vol. 162, (2002), pp. 855-666.
Pwee, K.-H., et al., "Isolation, Partial Purification and Differential DNA-Binding Properties of Putative High-Mobility-Group Proteins from Rice", Plant Science, vol. 139, (1998), pp. 117-129.
Yanagisawa, S., "The Dof Family of Plant Transcription Factors", TRENDS in Plant Science, vol. 7, No. 12, (2002), pp. 555-560.

* cited by examiner

MEGVGARQRRNPLIPRP*NGS*KRHLQHQHQPNAAEKKTAATSNYFSIEAFLVLVFLTMSLLIL
PLVLPPLPPPPSLLLLLPVCLLILLVVLAFMPTDVRSMASSYL

FIGURE 1

CLUSTAL W (1.83) multiple sequence alignment

```
SEQID34     ----------------------------------------------------------------
SEQID35     ----------------------------------------------------------------
SEQID20     ------------MIREISNLQKD-----IINIQDS-YSNNRVMDV-GRNNR---KNMSFR
SEQID21     ------------MIREFSSLQND-----IINIQEH-YSLNNNMDVRGDHNR---KNTSFR
SEQID22     ------------MSIEQPEADSRLSEGPLINLQDR--YLSGIMEARGRRNSAPLQVERKN
SEQID23     ------------MNSDNSESRQRLSKG-IINLQDR--YPTSIMD-RG---------VRKI
SEQID24     ---------MNMDMESSEAKLRSSKG-FINLEEHQQYFNNIME--G--------------
SEQID25     -----------------------------------ME--G--------------
SEQID15     -----------------------MDSQFGALERG----GSRQRR------SP
SEQID16     -----------------------MDSQFGAMDRG----GSRQRS------SP
SEQID2      -----------------------MEGV----GARQRR------NP
SEQID14     -----------------------MASRSSAMEGG-----AAIQR---------
SEQID19     -----------------------MASRSSALEGGG---AAIQR---------
SEQID17     -----------------------MEGG----GQIQR---------
SEQID18     -----------------------MEGG----GQIQR---------
SEQID13     ------------------MLLEHLMITMEEQMFREQQMQRG------GR
SEQID12     MYLLSPRNGDEEDEQEEIQELISDDEPPNLKLASCATAASSSSSSGSDMEKGRGKACGGG

SEQID34     ------------MVR-----------------------CFSLGSVLILIALAASMVVLPL
SEQID35     ----------MIMVAS------KEKTNSG--------GCMFRYSVLILSLLALSILVLPL
SEQID20     -SSPE--KSKQELRRSFSAQK--RMMIPA--------NYFSLESLFLLVGLTASLLILPL
SEQID21     GSAPAPIMGKQELFRTLSSQNSPRRLISA--------SYFSLESMVVLVGLTASLLILPL
SEQID22     PTPPMAEGKKMEYNRTPLSRENSRRLIPA--------SYFSLESLLLLICLTASLLILPL
SEQID23     ATPPVEK-RKVEYHRS-YSQGASRKLFSA--------SYFTLESLLLLVCLTASLLILPL
SEQID24     --------NKMEHKRS-FTQGHGKKMLSM--------NYFSLESIILLLGLTASLLLLPL
SEQID25     --------NKMEHKRS-FTQGHGKKMLSM--------NYFSLESIILLLGLTASLLLLPL
SEQID15     VLARPNTTKRHIQQQ--RANAADKKVVMP--------NYFSIEAFFVLACLTVSLLILPL
SEQID16     VLARPNTAKRQMQQQ--RANAADKKVVIP--------NYFGVEAFFVLACLTVSLLILPL
SEQID2      LIPRPNGSKRHLQHQH-QPNAAEKKTAATS-------NYFSIEAFLVLVFLTMSLLILPL
SEQID14     ---RN-AVKRHLQQRQQEADFLDKKVIAS--------TYFSIGAFLVLACLTVSLLILPL
SEQID19     ---RNNAVKRHLQQRQQEADFHDKKVIAS--------TYFSIGAFLVLACLTFSLLILPL
SEQID17     ---RNNAVKRHLQQRQQEADFLDKKVIAS--------TYFSIEAFLVLACLTVSLLILPL
SEQID18     ---RNNAVKRHLQQRQQEADFLDKKVIAS--------TYFSIEAFLVLACLTVSLLILPL
SEQID13     HHQHHTTREQEQQQKQQQRRRLMNNATNGGGGDGGSRCYFSTEAILVLACVTSLLVLPL
SEQID12     STAPPPPPPSSSGKSGGGGGSNIREAAASGGGGGVWGKYFSVESLLLLVCVTASLVILPL
                                                  :  :..:*  ::  *:::***
```

FIGURE 2

```
SEQID34     MLPPLPPPPLALLFFPVGIMAALVVLAFSPSENV----KNVVV-----------------
SEQID35     VMPPLPPPPLLLLLVPVFIMLLLFFIAFSPSKKV----PNKAS-----------------
SEQID20     VLPPLPPPPFMLLLVPIGIMVLLVVLAFMPSSHSNANTDVTCN-----------------
SEQID21     ILPPLPPPPFMLLLIPIGIMVLLMVLAFMPSSNS-KHVSSSST-----------------
SEQID22     ILPPLPPPPFMLLLLPIGILAVLMILAFMPSNVR----DLTYT-----------------
SEQID23     VLPPLPPPPFLLLLVPIXILAVLLVLAFMPSNVR----DITST-----------------
SEQID24     MLPPLPPPPFMLLLVPIFILVVLMILAFMPSNVR----NVTCS-----------------
SEQID25     MLPPLPPPPFMLLLVPIFILVVLMILAFMPSNVR----NVTCS-----------------
SEQID15     VLPPLPPPPSLLLFVPVCLLILLMVLAFMPTDMR----SMATS-----------------
SEQID16     VLPPLPPPPSLLLLLPVCLLILLMVLAFMPTDVR----SMATS-----------------
SEQID2      VLPPLPPPPSLLLLLPVCLLILLVVLAFMPTDVR----SMASS-----------------
SEQID14     XXXXXXXXXXLLWLPVCLLVLLVVLAFMPTDVR----SMASS-----------------
SEQID19     VLPPLPPPPSLLLWLPVCLLVLLVVLAFMPTDVR----SVAAS-----------------
SEQID17     VLPXLPAPASLLLWLPVWLLELLIVLAFMPTDVR----SMASS-----------------
SEQID18     VLPPLPPPPSLLLWLPVCLLILLIVLAFMPTDVR----SMASS-----------------
SEQID13     ILPPLPPPPTLLLLLPVCLLALLVVLAFMPTDMR----TMASS-----------------
SEQID12     VLPPLPPPPSMLMLVPVAMLVLLLALAFMPTTTS----SSSSAGGGGGGGRNGATTGHAP
                        *: .*: ::   *. :** *:

SEQID34     YSSSSSGIANSKR
SEQID35     FVS----------
SEQID20     FM-----------
SEQID21     FM-----------
SEQID22     YV-----------
SEQID23     YV-----------
SEQID24     YL-----------
SEQID25     YL-----------
SEQID15     YL-----------
SEQID16     YL-----------
SEQID2      YL-----------
SEQID14     YL-----------
SEQID19     YL-----------
SEQID17     YL-----------
SEQID18     YL-----------
SEQID13     YL-----------
SEQID12     YL-----------
               :
```

FIGURE 2 (continued)

SEQ ID NO: 1, OsSYR coding sequence
ATGGAAGGTGTAGGTGCTAGGCAGAGGAGGAACCCTCTGATACCCAGACCAAACGGTTCAAA
GAGGCATCTGCAGCATCAGCATCAGCCAAATGCTGCCGAGAAGAAGACCGCCGCGACATCGA
ATTACTTCAGTATCGAGGCGTTCCTCGTGCTCGTCTTCCTCACCATGTCATTGCTCATACTT
CCATTGGTGCTTCCCCCATTGCCTCCGCCGCCATCGCTGCTGCTGCTGCTGCCAGTCTGCCT
GCTCATCCTGCTGGTTGTGCTGGCCTTCATGCCAACGGATGTGCGGAGCATGGCTTCCTCTT
ACTTGTAAATACATCTCCTAGGGGAATTTATTTTTGTTTTTGA

SEQ ID NO: 2, OsSYR deduced protein sequence
MEGVGARQRRNPLIPRPNGSKRHLQHQHQPNAAEKKTAATSNYFSIEAFLVLVFLTMSLLIL
PLVLPPLPPPPSLLLLLPVCLLILLVVLAFMPTDVRSMASSYL

SEQ ID NO: 3, prm08170, start codon in bold, AttB1 site in italics
*GGGGACAAGTTTGTACAAAAAAGCAGGCTTAAACA*ATGGAAGGTGTAGGTGCTAGG

SEQ ID NO: 4, prm08171, reverse, complementary, AttB2 site in italic
*GGGGACCACTTTGTACAAGAAAGCTGGGT*CAAAAACAAAAATAAATTCCCC

SEQ ID NO: 5, rice GOS2 promoter sequence
AATCCGAAAAGTTTCTGCACCGTTTTCACCCCCTAACTAACAATATAGGGAACGTGTGCTAA
ATATAAAATGAGACCTTATATATGTAGCGCTGATAACTAGAACTATGCAAGAAAAACTCATC
CACCTACTTTAGTGGCAATCGGGCTAAATAAAAAAGAGTCGCTACACTAGTTTCGTTTTCCT
TAGTAATTAAGTGGGAAAATGAAATCATTATTGCTTAGAATATACGTTCACATCTCTGTCAT
GAAGTTAAATTATTCGAGGTAGCCATAATTGTCATCAAACTCTTCTTGAATAAAAAAATCTT
TCTAGCTGAACTCAATGGGTAAAGAGAGAGATTTTTTTTAAAAAAATAGAATGAAGATATTC
TGAACGTATTGGCAAAGATTTAAACATATAATTATATAATTTTATAGTTTGTGCATTCGTCA
TATCGCACATCATTAAGGACATGTCTTACTCCATCCCAATTTTTATTTAGTAATTAAAGACA
ATTGACTTATTTTTATTATTTATCTTTTTTTCGATTAGATGCAAGGTACTTACGCACACACTT
TGTGCTCATGTGCATGTGTGAGTGCACCTCCTCAATACACGTTCAACTAGCAACACATCTCT
AATATCACTCGCCTATTTAATACATTTAGGTAGCAATATCTGAATTCAAGCACTCCACCATC
ACCAGACCACTTTTAATAATATCTAAAATACAAAAAATAATTTTACAGAATAGCATGAAAAG
TATGAAACGAACTATTTAGGTTTTTCACATACAAAAAAAAAAGAATTTTGCTCGTGCGCGA
GCGCCAATCTCCCATATTGGGCACACAGGCAACAACAGAGTGGCTGCCCACAGAACAACCCA
CAAAAAACGATGATCTAACGGAGGACAGCAAGTCCGCAACAACCTTTTAACAGCAGGCTTTG
CGGCCAGGAGAGAGGAGGAGAGGCAAAGAAAACCAAGCATCCTCCTCCTCCCATCTATAAAT
TCCTCCCCCCTTTTCCCCTCTCTATATAGGAGGCATCCAAGCCAAGAAGAGGGAGAGCACCA
AGGACACGCGACTAGCAGAAGCCGAGCGACCGCCTTCTTCGATCCATATCTTCCGGTCGAGT
TCTTGGTCGATCTCTTCCCTCCTCCACCTCCTCCTCACAGGGTATGTGCCCTTCGGTTGTTC
TTGGATTTATTGTTCTAGGTTGTGTAGTACGGGCGTTGATGTTAGGAAAGGGGATCTGTATC
TGTGATGATTCCTGTTCTTGGATTTGGGATAGAGGGGTTCTTGATGTTGCATGTTATCGGTT
CGGTTTGATTAGTAGTATGGTTTTCAATCGTCTGGAGAGCTCTATGGAAATGAAATGGTTTA
GGGTACGGAATCTTGCGATTTTGTGAGTACCTTTTGTTTGAGGTAAAATCAGAGCACCGGTG
ATTTTGCTTGGTGTAATAAAAGTACGGTTGTTTGGTCCTCGATTCTGGTAGTGATGCTTCTC
GATTTGACGAAGCTATCCTTTGTTTATTCCCTATTGAACAAAAATAATCCAACTTTGAAGAC
GGTCCCGTTGATGAGATTGAATGATTGATTCTTAAGCCTGTCCAAAATTTCGCAGCTGGCTT
GTTTAGATACAGTAGTCCCCATCACGAAATTCATGGAAACAGTTATAATCCTCAGGAACAGG

FIGURE 5

GGATTCCCTGTTCTTCCGATTTGCTTTAGTCCCAGAATTTTTTTCCCAAATATCTTAAAAA
GTCACTTTCTGGTTCAGTTCAATGAATTGATTGCTACAAATAATGCTTTTATAGCGTTATCC
TAGCTGTAGTTCAGTTAATAGGTAATACCCCTATAGTTTAGTCAGGAGAAGAACTTATCCGA
TTTCTGATCTCCATTTTTAATTATATGAAATGAACTGTAGCATAAGCAGTATTCATTTGGAT
TATTTTTTTTATTAGCTCTCACCCCTTCATTATTCTGAGCTGAAAGTCTGGCATGAACTGTC
CTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAA
TCGGGATAGTTATACTGCTTGTTCTTATGATTCATTTCCTTTGTGCAGTTCTTGGTGTAGCT
TGCCACTTTCACCAGCAAAGTTC

SEQ ID NO: 6, conserved motif 1a
YFS

SEQ ID NO: 7, conserved motif 1b
YFT

SEQ ID NO: 8, conserved motif 1c
YFG

SEQ ID NO: 9, conserved motif 1d
YLG

SEQ ID NO: 10, conserved motif 2
(V/A/I)LAFMP(T/S)

SEQ ID NO: 11, conserved motif 3
(S/P)YL

SEQ ID NO: 12, rice SYR homologue 1 (XP_472637), encoded by SEQ ID NO: 27
MYLLSPRNGDEEDEQEEIQELISDDEPPNLKLASCATAASSSSSSGSDMEKGRGKACGGGST
APPPPPPSSSGKSGGGGGSNIREAAASGGGGGVWGKYFSVESLLLLVCVTASLVILPLVLPP
LPPPPSMLMLVPVAMLVLLLALAFMPTTTSSSSSAGGGGGGGRNGATTGHAPYL

SEQ ID NO: 13, rice SYR homologue 2, deduced protein sequence (AP008218)
MLLEHLMITMEEQMFREQQMQRGGRHHQHHTTREQEQQQKQQQRRRLMNNATNGGGGDGGSR
CYFSTEAILVLACVTVSLLVLPLILPPLPPPPTLLLLLPVCLLALLVVLAFMPTDMRTMASS
YL

SEQ ID NO: 14, corn SYR homologue (AY110705), encoded by SEQ ID NO: 28
MASRSSAMEGGAAIQRRNAVKRHLQQRQQEADFLDKKVIASTYFSIGAFLVLACLTVSLLIL
PLXXXXXXXXXXXLLWLPVCLLVLLVVLAFMPTDVRSMASSYL

SEQ ID NO: 15, wheat SYR homologue, deduced protein sequence (CK211328)
MDSQFGALERGGSRQRRSPVLARPNTTKRHIQQQRANAADKKVVMPNYFSIEAFFVLACLTV
SLLILPLVLPPLPPPPSLLLFVPVCLLILLMVLAFMPTDMRSMATSYL

FIGURE 5 (continued)

SEQ ID NO: 16, barley SYR homologue (CB871444), encoded by SEQ ID NO: 36
MDSQFGAMDRGGSRQRSSPVLARPNTAKRQMQQQRANAADKKVVIPNYFGVEAFFVLACLTV
SLLILPLVLPPLPPPPSLLLLLPVCLLILLMVLAFMPTDVRSMATSYL SEQ ID NO: 17, sugar cane SYR homologue 1 encoded by SEQ ID NO: 37 (CA165713)
MEGGGQIQRRNNAVKRHLQQRQQEADFLDKKVIASTYFSIEAFLVLACLTVSLLILPLVLPX
LPAPASLLLWLPVWLLELLIVLAFMPTDVRSMASSYL SEQ ID NO: 18, sugar cane SYR homologue 2 encoded by SEQ ID NO: 38(CA242805)
MEGGGQIQRRNNAVKRHLQQRQQEADFLDKKVIASTYFSIEAFLVLACLTVSLLILPLVLPP
LPPPPSLLLWLPVCLLILLIVLAFMPTDVRSMASSYL SEQ ID NO: 19, sorghum SYR homologue, encoded by SEQ ID NO: 39 (CX611532)
MASRSSALEGGGAAIQRRNNAVKRHLQQRQQEADFHDKKVIASTYFSIGAFLVLACLTFSLL
ILPLVLPPLPPPPSLLLWLPVCLLVLLVVLAFMPTDVRSVAASYL SEQ ID NO: 20, *Arabidopsis thaliana* SYR homologue 1, encoded by SEQ ID NO: 40 (NM_115853)
MIREISNLQKDIINIQDSYSNNRVMDVGRNNRKNMSFRSSPEKSKQELRRSFSAQKRMMIPA
NYFSLESLFLLVGLTASLLILPLVLPPLPPPPFMLLLVPIGIMVLLVVLAFMPSSHSNANTD
VTCNFM SEQ ID NO: 21, *Arabidopsis thaliana* SYR homologue 2, encoded by SEQ ID NO: 41 (NM_180078)
MIREFSSLQNDIINIQEHYSLNNNMDVRGDHNRKNTSFRGSAPAPIMGKQELFRTLSSQNSP
RRLISASYFSLESMVVLVGLTASLLILPLILPPLPPPPFMLLLIPIGIMVLLMVLAFMPSSN
SKHVSSSSTFM SEQ ID NO: 22, grape SYR homologue (CF404276), encoded by SEQ ID NO: 29

MSIEQPEADSRLSEGPLINLQDRYLSGIMEARGRRNSAPLQVERKNPTPPMAEGKKMEYNRT
PLSRENSRRLIPASYFSLESLLLLICLTASLLILPLILPPLPPPPFMLLLLPIGILAVLMIL
AFMPSNVRDLTYTYV

SEQ ID NO: 23, citrus SYR homologue (CF830612), encoded by SEQ ID NO: 30
MNSDNSESRQRLSKGIINLQDRYPTSIMDRGVRKIATPPVEKRKVEYHRSYSQGASRKLFSA
SYFTLESLLLLVCLTASLLILPLVLPPLPPPPFLLLLVPIXILAVLLVLAFMPSNVRDITST
YV SEQ ID NO: 24, tomato SYR homologue 1 (AI774560), encoded by SEQ ID NO: 32
MNMDMESSEAKLRSSKGFINLEEHQQYFNNIMEGNKMEHKRSFTQGHGKKMLSMNYFSLESI
ILLLGLTASLLLLPLMLPPLPPPPFMLLLVPIFILVVLMILAFMPSNVRNVTCSYL

FIGURE 5 (continued)

SEQ ID NO: 25, tomato SYR homologue 2, partial sequence (BG125370), encoded by SEQ ID NO: 31
MEGNKMEHKRSFTQGHGKKMLSMNYFSLESIILLLGLTASLLLLPLMLPPLPPPPFMLLLVP
IFILVVLMILAFMPSNVRNVTCSYL SEQ ID NO: 26, *Arabidopsis thaliana* ARGOS protein (AY305869), encoded by SEQ ID NO: 42
MDVGRNNRKNMSFRSSPEKSKQELRRSFSAQKRMMIPANYFSLESLFLLVGLTASLLILPLV
LPPLPPPPFMLLLVPIGIMVLLVVLAFMPSSHSNANTDVTCNFM SEQ ID NO: 27, *Oryza sativa* SYR homologue, mRNA, (XM_472637), encoding protein of SEQ ID NO: 12
ATGTACTTGTTGAGCCCAAGAAATGGCGACGAGGAGGACGAACAGGAGGAAATCCAGGAGCT
GATCAGCGACGACGAGCCGCCCAATCTCAAGTTGGCATCCTGCGCCACTGCAGCCAGCAGCA
GCAGCAGCAGCGGCAGCGACATGGAGAAGGGAAGAGGTAAAGCCTGCGGCGGCGGGAGTACG
GCGCCGCCGCCGCCGCCGTCGTCGTCAGGTAAATCCGGCGGCGGCGGCGGCAGCAATAT
CAGGGAGGCGGCGGCTAGCGGCGGCGGCGGCGGCGTGTGGGGCAAGTACTTCTCGGTGGAGT
CGCTGCTCCTGCTGGTGTGCGTGACGGCGTCGCTGGTGATCCTCCCGCTCGTGCTGCCGCCG
CTGCCCCCGCCGCCGTCGATGCTGATGCTGGTGCCGGTGGCGATGCTGGTGCTGCTGCTGGC
GCTGGCGTTCATGCCGACGACGACGTCGTCGTCGTCGTCCGCCGGCGGCGGCGGCGGCGGCG
GCCGCAATGGGGCGACGACGGGACATGCTCCCTACTTGTAG SEQ ID NO: 28, corn SYR homologue, mRNA (AY110705), encoding protein of SEQ ID NO: 14
TTCACATTACACTCATGACTCGTCTTAGGACGAATCCTGCAGCTGCAAAACACAGAAAATCT
GGCCAAGACCTATTTATCTATTTACAGGTAAGAGGAGGCCATGCTGCGCACATCTGTCGGCA
TGAAGGCCAGTACAACCAGCAAGACGAGCAGGCAGACCGGCAGCCACAGCAGNNNNNNNNNN
NNNNNNNNNNNNNNNNNNNNNNNNNCCAGCGGCAGTATCAGCAGCGAGACGGTGAGGCAGGCGAG
CACGAGGAATGCCCCGATGCTGAAGTAGGTGGACGCGATGACCTTCTTGTCGAGGAAATCCG
CCTCCTGCTGACGCTGCTGCAGATGCCGCTTCACGGCATTCCTCCTTTGTATTGCCGCCCCT
CCTTCCATCGCGCTAGATCGGCTTGCCATGTGTTCTTTGGTGTAGGCGGAGGTGGAGACCAG
TCGCAGTGAGTGGTTGCCAAAGTAAGCAAGAAGTGAAAGGCGGTGTAGAACCGCCTTGNGTT
TTCTGAACGTTTTGTAATCAGATCTGAGCTCGGGTGGTCGAA SEQ ID NO: 29, *Vitis vinifera* cDNA clone CSECS024D03 3' mRNA sequence (CF404276, reverse complement), encodes SEQ ID NO: 22
TACTTTGAACCGGTTGGAACTTGGTGACCGGTAAAGGAGAAATTTAAATGAGTATTGAGCAG
CCTGAAGCAGATTCAAGACTGTCTGAAGGACCTTTGATCAATCTGCAAGATCGATATTTGAG
TGGCATCATGGAAGCGAGAGGAAGGAGGAACTCTGCTCCTCTGCAAGTTGAGAGGAAAAACC
CTACTCCTCCTATGGCCGAAGGAAAGAAGATGGAATATAATAGAACTCCCCTCTCACGAGAG
AACAGCAGGAGACTGATCCCAGCAAGCTATTTCAGCTTGGAGTCATTGCTTTTGCTCATCTG
TCTCACGGCTTCATTGCTGATCCTTCCCCTGATACTACCACCATTGCCACCCCCTCCTTTCA
TGCTGCTTCTGCTCCCCATTGGCATTCTAGCAGTGCTTATGATCTTGGCTTTCATGCCTTCT
AATGTCAGAGATTTGACTTATACATATGTGTAAATGGTGGTGTTCAAAAGTGCACCTCTTCT
CATCATACAATTTTTGTTATTTGTCTTGATATTCAGATGAAAATCAGTTATTTTATTTCTTG
ATTAAAAAAAAAAAAAAAAAA

FIGURE 5 (continued)

SEQ ID NO: 30, Citrus reticulata cDNA clone CR_CEa05B13, mRNA
sequence (CF830612), encoding SEQ ID NO: 23 (nt 313-693)
AGGGTTTCTTCAAAGATAGGTAGCCATTTGCACATTTGAATCTGCTTGTTGGATATTGTCAA
GGAGGCTGTTGGAATTAGGCCACATTTCAGAATCTGGTTTCATCCTGGATCGCTGGGCATTT
GAAGGCATTTTGTGATCATCGCTGTTTAAAATTTGGCCGCATATTAGAATCTGGGTTCTCAT
CGGTTTTCCGTACATTTACCTTGACCACATTTTGATATCTGGGTTGAGCTGCATTTTAGCCT
TCGTATTTAAAAGGACTTGATCTAATCTGGGGTCTTGGTGAGCCGGGGCAACTGATCATAGT
AAATGAATTCTGATAATTCTGAGTCGAGACAGAGACTATCAAAGGGCATTATAAACTTGCAA
GATCGATATCCGACCAGCATTATGGATCGTGGTGTAAGAAAAATTGCAACTCCTCCGGTCGA
GAAGAGGAAAGTTGAGTATCACCGAAGTTACTCGCAAGGGGCATCCAGAAAACTGTTTTCGG
CAAGCTATTTCACCCTGGAATCATTGCTTTTGCTCGTATGTCTGACGGCCTCATTGCTGATC
CTGCCATTGGTGCTTCCGCCCTTGCCGCCCCGCCATTCCTGCTGCTTCTGGTTCCTATANG
TATTCTAGCCGTGCTTTTGGTCTTGGCATTCATGCCTTCTAATGTAAGAGATATAACTTCCA
CGTACGTGTAAATGGTGTTGCT SEQ ID NO: 31, Lycopersicon esculentum cDNA clone cTOF8M10 5'
sequence, partial mRNA sequence (BG125370)encoding SEQ ID NO:
25
GAAAAAAATGTATTTAATCATTATGTAAAAAACAAGTGAATCTACTTTGATATTTTCTTCTA
AATTAAACCACACAATTAAAGATATGAGCAAGTCACATTCCTAACATTAGAAGGCATAAAAG
CTAAGATCATAAGAACAACAAGAATGAAAATTGGGACTAACAACAACATAAAAGGTGGTGGT
GGCAATGGTGGAAGCATCAATGGCAAAAGTAACAAAGATGCTGTAAGACCAAGTAACAAAAT
AATTGACTCTAAGCTAAAATAATTCATTGACAACATTTTCTTGCCATGTCCTTGTGTAAATG
ATCTCTTATGCTCCATCTTATTGCCTTCCATAATGTTGTTGAAATATTGTTGATGTTCCTCC
AAATTAATAA SEQ ID NO: 32, Lycopersicon esculentum cDNA clone cTOF8M10 5'
sequence, mRNA sequence (AI774560), encoding SEQ ID NO: 24
TTTGTTAAAGATTGGCACATTTTCAAGTTCAGTATTCATTCGATTTTTGATATCTACATAAA
AAAAAAGTGTCCTGGTACTACTCAATATTCCTCAGAACGACTTCATATTCAGGTCTCGAATT
CAAAACCTCACATCAAGATTCTTAGGAAATTTCAAGATTGGTTGAAAAACTCATATCCTTCT
CTAAGTTTCAAGATTGGTTCCAAATTAAAACTCGAGACTTCTGAGTAAGAGCGTACGACTAG
TAATGAACATGGACATGGAATCATCAGAGGCAAAATTGAGATCATCAAAAGGGTTTATTAAT
TTGGAGGAACATCAACAATATTTCAACAACATTATGGAAGGCAATAAGATGGAGCATAAGAG
ATCATTTACACAAGGACATGGCAAGAAATGTTGTCAATGAATTATTTTAGCTTAGAGTCAA
TTATTTTGTTACTTGGTCTTACAGCATCTTTGTTACTTTTGCCATTGATGCTTCCACCATTG
CCACCACCACCTTTTATGTTGTTGTTAGTCCCAATTTTCATTCTTGTTGTTCTTATGATCTT
AGCTTTTATGCCTTCTAATGTTAGGAATGTGACTTGCTCATATCTTTAATTGTGTGGTTTAA
TTTA SEQ ID NO: 33, PRO0170 - High mobility group protein promoter
CATGCGGCTAATGTAGATGCTCACTGCGCTAGTAGTAAGGTACTCCAGTACATTATGGAATA
TACAAAGCTGTAATACTCGTATCAGCAAGAGAGAGGCACACAAGTTGTAGCAGTAGCACAGG
ATTAGAAAAACGGGACGACAAATAGTAATGGAAAAACAAAAAAAAACAAGGAAACACATGGC
AATATAAATGGAGAAATCACAAGAGGAACAGAATCCGGGCAATACGCTGCGAAAGTACTCGT
ACGTAAAAAAAGAGGCGCATTCATGTGTGGACAGCGTGCAGCAGAAGCAGGGATTTGAAAC
CACTCAAATCCACCACTGCAAACCTTCAAACGAGGCCATGGTTTGAAGCATAGAAAGCACAG-

FIGURE 5 (continued)

GTAAGAAGCACAACGCCCTCGCTCTCCACCCTCCCACCCAATCGCGACGCACCTCGCGGATC
GGTGACGTGGCCTCGCCCCCCAAAAATATCCCGCGGCGTGAAGCTGACACCCCGGGCCCACC
CACCTGTCACGTTGGCACATGTTGGTTATGGTTCCCGGCCGCACCAAAATATCAACGCGGCG
CGGCCCAAAATTTCCAAAATCCCGCCCAAGCCCCTGGCGCGTGCCGCTCTTCCACCCAGGTC
CCTCTCGTAATCCATAATGGCGTGTGTACCCTCGGCTGGTTGTACGTGGGCGGGTTACCCTG
GGGGTGTGGGTGGATGACGGGTGGGCCCGGAGGAGGTCCGGCCCCGCGCGTCATCGCGGGC
GGGGTGTAGCGGGTGCGAAAAGGAGGCGATCGGTACGAAAATTCAAATTAGGAGGTGGGGGG
CGGGGCCCTTGGAGAATAAGCGGAATCGCAGATATGCCCCTGACTTGGCTTGGCTCCTCTTC
TTCTTATCCCTTGTCCTCGCAACCCCGCTTCCTTCTCTCCTCTCCTCTTCTCTTCTCTTCTC
TGGTGGTGTGGGTGTGTCCCTGTCTCCCCTCTCCTTCCTCCTCTCCTTTCCCCTCCTCTCTT
CCCCCCTCTCACAAGAGAGAGAGCGCCAGACTCTCCCCAGGTGAGGTGAGACCAGTCTTTTT
GCTCGATTCGACGCGCCTTTCACGCCGCCTCGCGCGGATCTGACCGCTTCCCTCGCCCTTCT
CGCAGGATTCAGCC

SEQ ID NO: 34
MVRCFSLGSVLILIALAASMVVLPLMLPPLPPPPLALLFFPVGIMAALVVLAFSPSENVKNV
VVYSSSSSGIANSKR

SEQ ID NO: 35
MIMVASKEKTNSGGCMFRYSVLILSLLALSILVLPLVMPPLPPPPLLLLLVPVFIMLLLFFI
AFSPSKKVPNKASFVS

SEQ ID NO: 36, CB871444 HC03001y CH Hordeum vulgare cDNA clone
HC03001 3-PRIME, reverse complement mRNA sequence encoding SEQ
ID NO: 16
CTTCCGAGAAAGATGCTTCATATTGCACTCATCTTATGCCAACACACAATCAGAAACAAAAA
CCACGCAGCAAGCCTATTTACAAGTAAGAGGTGGCCATGCTCCGCACATCAGTCGGCATGAA
GGCCAGCACCATCAACAGGATGAGCAAGCAGACCGGCAAGAGCAGCAGTAGCGATGGCGGTG
GGGGCAACGGAGGCAGCACCAATGGCAGTATGAGCAATGAAACGGTGAGGCAGGCGAGCACG
AAGAACGCTTCGACGCCGAAGTAGTTCGGTATGACAACCTTCTTGTCAGCAGCATTTGCCCT
CTGCTGCTGCATTTGCCTCTTTGCAGTATTTGGTCTGGCTAACACAGGGCTGCTCCTCTGCC
TACTACCGCCTCTGTCCATTGCACCGAACTGGCTATCCATCTATTCTTTGGTGAGTGCAGAT
CAGCGGCTATCCAGGAACTGAGATGAATAAGAACTTGTGGAATCTGAAGGTTTTTAACAGAT
CTGAAGTCTTTGTGAGTCCGTGACTGAACTGCAGATCATCTGCTGTGGAAGAACTGCACCGC
AAGTGGCAATACCTTCGATCCTGAAACTTGCATTTTGGTGATGCCCGTACCACGC SEQ ID NO: 37, CA165713 SCUTRZ3071B09.g RZ3 Saccharum
officinarum cDNA clone SCUTRZ3071B09 5', mRNA sequence,
encoding SEQ ID NO: 17
GGAGAACGTGCTTGTTCAGGTGGTTCAACAGTGCGGACCAGAGAACAATGCGAGGTTCAGGA
TTAAAGGTATTCTGGCTTCAGAGGCAGTTCTTCCAAAGCAAGTGACAGGCGATTCCATCACC
GGAGCTAAGATCTTATTACAACATTCAGAAACACAGGAGTCCTCCCACCGCCTTTCACTTCT
TGCTTACTTCTGCAACCACTCGCCGTGACTGATCTCCACGCACACCAAAGAACACAACACGT
GGCAAGCCGATCTAGCGCGATGGAAGGAGGGGGCAAATACAGAGGAGGAATAATGCCGTGA
AGCGGCACCTGCAGCAGCGGCAGCAGGAGGCGGATTTCCTCGACAAGAAGGTCATCGCGTCC
ACCTATTTCAGCATCGAGGCGTTCCTCGTGCTCGCCTGCCTCACCGTCTCGCTGCTGATACT
GCCGCTTGTGCTGCCGNCGCTGCCGGCGCCGGCGTCGCTGCTGCTGTGGCTGCCGGTCTGGC
TGCTCGAACTGCTGATTGTGCTTGCCTTCATGCCGACAGATGTGCGCAGCATGGCCTCCTCT
TACTTGTAAAAAAATAGATAAATAGGCCACCTTTGGCAATTTTCTGGGGTTTGGAGGTG

FIGURE 5 (continued)

SEQ ID NO: 38, reverse complement of CA242805 SCSFFL3090G07.b
Saccharum officinarum FL3 Saccharum officinarum cDNA clone
SCSFFL3090G07 3', mRNA sequence, encoding SEQ ID NO: 18

GATTTTTTCCAAGCCAGTGACCGGCGATTCATCAACCGGAGCTGAGATCTTATACAACATTC
AGAAACACAGGAGTCCTCGCACCGCTTTCCACTCTTGGCTAATTTTGCAACCACTCGCCGTG
ACTGATCTCCACGCACACCAAAGAACACAACACGTGGCAACCCGATCTAGCGCGATGGAAGG
AGGGGGGCAAATACAGAGGAGGAATAATGCCGTGAAGCGGCACCTGCAGCAGCGGCAGCAGG
AGGCGGATTTCCTCGACAAGAAGGTCATCGCGTCCACCTATTTCAGCATCGAGGCGTTCCTC
GTGCTCGCCTGCCTCACCGTCTCGCTGCTGATACTGCCGCTGGTGCTGCCGCCGCTGCCGCC
GCCGCCGTCGCTGCTGCTGTGGCTGCCGGTCTGCCTGCTCATCCTGCTGATTGTGCTGGCCT
TCATGCCGACAGATGTGCGCAGCATGGCCTCCTCTTACTTGTAATAAATAGATAAATAGGCC
ACCTTGGTCAATATTCTGTGATTTGGAGGTGATTCGTCCTGAGATGAGTCTCGATTGATGTC
AGCTACTCCCAAGGGGAAATGCATGTAACACTTGGTGGCCGACGGTGGCAAGATAATCATGC
TACCATGTCAGTTAAACC

SEQ ID NO: 39, CX611532 ANR1_25_E08.b1_A002 Anaerobic roots
Sorghum bicolor cDNA clone ANR1_25_E08_A002 3', mRNA sequence
encoding SEQ ID NO: 19
GCTGTTGGTGTTGTTCTTGAGATCTCTTTCTTGATCTTGTGTGGGATTAAAGAGGGATTCTT
GCCTTCCTACGGGAGAAAGAGAAAAGGGGAAGAACGTGCTTGTTCCGGTGGTTCAACAGTGC
GGAGACCCGGAGAACAATGCGAGGTTCAGGATTAAAGGTGTTCTGGCTTCAGGTGCAGTTCT
TCCAAAGCAGGTGACAGGCGATTCGATCACCGGAGCTCAGATCTGACGAAAACAAAACACAG
TCCTCCTCCCACCGCCTTTCAGTTCTTGCTTACTTCTGCAACCACTCACTGCGACCGTACAC
CAAAGAACACTGCACATGGCAAGCCGATCTAGCGCGCTGGAAGGAGGGGGGCAGCAATACA
GCGGAGGAATAATGCCGTGAAGCGGCACCTGCAGCAGCGGCAGCAGGAGGCGGATTTCCACG
ACAAGAAGGTCATCGCGTCCACCTACTTCAGCATCGGCGCGTTCCTGGTGCTCGCCTGCCTC
ACCTTCTCGCTGCTCATCCTGCCGCTGGTGCTGCCGCCGCTGCCGCCGCCGCCGTCGCTGCT
GCTGTGGCTGCCGGTCTGCCTGCTCGTCCTGCTGGTTGTGCTGGCCTTCATGCCGACAGATG
TGCGCAGCGTGGCGGCCTCTTACTTGTAAATAGCCAGATAAATAGGCCACCACCTTTGGCCA
GTTTTCTGTGTTTTCGGGGGTGATTCGTCCTAAGATGAGTCATGATCGAGTGTAATGTGAAG
CATCTTTTCCAGGGGTAGTAGATTTCAATGAAGT SEQ ID NO: 40, NM_115853.3| Arabidopsis thaliana unknown
protein (AT3G59900) mRNA, complete cds, encoding SEQ ID NO: 20
TTGTCTTCCTCATTTCCCTACTAGTACTTGTTTCACACAGTTTCTTGATCCAACCAAAACCA
ATACACAAAGCTTCTCAAACTCCTTCACCTCAAAGCTTCTTCCTTTACATCTGAATCGTTGA
GTTAACTCGGATTTGTTCTGCATCCTCTGTTTCTGAATCGTGGGCCATCCTTATTTTGTCTC
GAATTCTTCACCAATTGCTTCGATCAAGCTGCATTGGTTAACCAGTTGCCCTAAAGATCAGA
TCTTTGAGCAAAATTTTGTCACTGATCTTCTAAATCCAAACCAGACACAGCAAAACAACCTC
TGTAGATGATTCGAGAAATCTCAAACTTACAAAAAGATATTATAAACATTCAAGACAGTTAT
TCGAACAACCGAGTCATGGACGTCGGAAGAAACAACCGGAAAAACATGAGCTTTCGAAGTTC
GCCGGAGAAAAGCAAGCAAGAGTTACGGCGGAGTTTCTCGGCGCAGAAAAGGATGATGATCC
CGGCGAATTATTTCAGTTTAGAGTCTCTGTTCCTATTGGTTGGTCTAACGGCATCTCTGTTA
ATACTTCCGTTAGTTTTGCCGCCGTTACCTCCGCCTCCGTTTATGCTGCTATTGGTTCCCAT
TGGGATTATGGTTTTACTCGTCGTTCTTGCCTTCATGCCTTCTTCTCATTCTAATGCTAATA
CAGATGTAACTTGCAATTTCATGTAAATCTGAAATTTATTATATGATGAT

FIGURE 5 (continued)

SEQ ID NO: 41, NM_180078.2| Arabidopsis thaliana unknown protein (AT2G44080) mRNA, complete cds, encoding SEQ ID NO: 21
CCCACTTTATTTCTTCTTCTCTGGTTTTCTTACCAAAAGAAACTTTCTTCGTCTTCCTCTGT
ATTTAAGCTTTAACACCCTGTTTTTGGTTTCCAACGTTCAATCTTCATCTTCTTCTCGCTGA
AGGTGTGTTTGGCTCTAACGGTTTAAAGCTTTCTTGAAACACCAATTGAATCTTTTCTCTCT
ACCGGCAAAAAAAAAAGATTAGTCCTTTTAGGTCTGGAAACGCCAAGATCACTCGTTCTAAA
CCTTAGATTTTGTCTGCATTTCGGGATAATCATTTCATCGTCAGGGTTCTTCAACCAAACTA
CATTTACAGAAGAAGAAGAAGAAGAAAAGTTCGTTACTTTTTATGCGTTTGGATAAACAAAC
TCAAGTTTCTTCTTCATACATCGATCTGATTTTCCAGATCAAACTTCGAAAAGAGAAAAAGC
CTTCTTTAAATGATTCGTGAGTTCTCCAGTCTACAAAACGACATCATAAACATTCAAGAACA
TTATTCTCTCAACAACAACATGGACGTGAGAGGAGATCATAACCGGAAAAACACGAGTTTTC
GTGGTTCAGCTCCAGCTCCGATTATGGGGAAGCAAGAATTGTTTCGGACATTGTCGTCGCAG
AACAGTCCAAGGAGGCTAATATCAGCGAGTTACTTCAGTTTAGAATCAATGGTTGTGCTTGT
TGGTCTCACAGCATCTCTCTTGATCTTACCGTTGATTCTTCCACCATTGCCTCCTCCTCCTT
TTATGCTGCTTTTGATTCCTATTGGGATTATGGTTTTGCTTATGGTTCTTGCTTTCATGCCT
TCTTCTAATTCCAAACATGTTTCTTCTTCTTCCACTTTTATGTAATAAACGTTTCTTTAATT
GAAGAAAGAAATCCTTAAACAAA SEQ ID NO: 42, AY305869.1| Arabidopsis thaliana auxin-inducible protein (ARGOS) mRNA, complete cds, encoding SEQ ID NO: 26
TTGTCTTCCTCATTTCCCTACTAGTACTTGTTTCACACAGTTTCTTGATCCAACCAAAACCA
ATACACAAAGCTTCTCAAACTCCTTCACCTCAAAGCTTCTTCCTTTACATCTGAATCGTTGA
GTTAACTCGGATTTGTTCTGCATCCTCTGTTTCTGAATCGTGGGCCATCCTTATTTTGTCTC
GAATCTTCACCAATTGCTTCGATCAAGCTGCATTGGTTAACCAGTTGCCCTAAAGATCAGA
TCTTTGAGCAAAATTTTGTCACTGATCTTCTAAATCCAAACCAGACACAGCAAAACAACCTC
TGTAGATGATTCGAGAAATCTCAAACTTACAAAAGATATTATAAACATTCAAGACAGTTAT
TCGAACAACCGAGTCATGGACGTCGGAAGAAACAACCGGAAAAACATGAGCTTTCGAAGTTC
GCCGGAGAAAAGCAAGCAAGAGTTACGGCGGAGTTTCTCGGCGCAGAAAAGGATGATGATCC
CGGCGAATTATTTCAGTTTAGAGTCTCTGTTCCTATTGGTTGGTCTAACGGCATCTCTGTTA
ATACTTCCGTTAGTTTTGCCGCCGTTACCTCCGCCTCCGTTTATGCTGCTATTGGTTCCCAT
TGGGATTATGGTTTTACTCGTCGTTCTTGCCTTCATGCCTTCTTCATTCTAATGCTAATA
CAGATGTAACTTGCAATTTCATGTAAATCTGAAATTTATTATATGATGAT SEQ ID NO: 43, Zea mays SYR protein-encoding nucleic acid, ZM57451407
ATGCGAGGTTCGGGATTTAAGATGTTCGGCTTTAGGGGCAGTTCTTCTGAAGCAGGGGACGG
GCGATTCGACCACCGGAGCTCAGATCTGATTACAAAACGTTCAGAAAACACAAGGCGTTCTC
ACACCGCCTTTCACTTCTTGCTTACTTTGGCAACCACTCACTGCGACTGGTCTCCACCTCCA
CCTACACCAAGAACACATGGCAAGCCGATCTACGCGATGGAAGGAGGGGCGGCAATACAAAG
GAGGAATGCCGTGAAGCGGCATCTGCAGCAGCGTCAGCAGGAGGCGGATTTCCTCGACAAGA
AGGTCATCGCGTCCACCTACTTCAGCATCGGGGCGTTCCTCGTGCTCGCCTGCCTCACCGTC
TCGCTGCTGATACTGCCGCTGGTGCTGCCTCCCCTGCCGCCGCCGCCGTCGCTGCTGTTGTG
GCTGCCGGTCTGCCTGCTCGTCTTGCTGGTTGTACTGGCCTTCATGCCGACAGATGTGCGCA
GCATGGCCTCCTCTTACCTGTAA SEQ ID NO: 44, Zea mays SYR protein, ZM57451407
MEGGAAIQRRNAVKRHLQQRQQEADFLDKKVIASTYFSIGAFLVLACLTVSLLILPLVLPPL
PPPPSLLLWLPVCLLVLLVVLAFMPTDVRSMASSYL FIGURE 5 (continued)

MKSRARQCLLVCLLCLSLTNLSYGENKFRERKATDDELGYPDIDEDALLN
TQCPKKLELRWQTEVTSSVYATPLIADINSDGKLDIVVPSFVHYLEVLEG
ADGDKMPGWPAFHQSNVHSSPLLFDIDK*DGVRE*IALATYNAEVLFFRVSG
FLMSDKLEVPRRKVHKNWHVGLNPDPVDRSHPDVHDDVLEEEAMAMKSST
TQTNATTTTPNVTVSMTKEVHGANSYVSTQEDQKRPENNQTEAIVKPTPE
LHNSSMDAGANNLAANATTAGSRENLNRNVTTNEVDQSKISGDKNETVIK
LNTSTGNSSETLGTSGNSSTAETVTKSGRRLLEE*DGSKES*VDSHSDSKDN
SEGVRMATVEN*DGGLE*ADADSSFELLRENDELADEYSYDYDDYVDEKMWG
DEEWVEGQHENSEDYVNIDAHILCTPVIADIDK*DGVQE*MIVAVSYFFDPE
YYDNPEHLKELGGIDIKNYIASSIVVFNLDTKQVKWIKELDLSTDKANFR
AYIYSSPTVVDLDG*DGYLD*ILVGTSFGLFYAMDHRGNIREKFPLEMAEIQ
GAVVAADIND*DGKTE*LVTTDSHGNIAAWTTQGVEIWEAHLKSLVPQGPSI
GDVDG*DGHTE*VVVPTSSGNIYVLSGKDGSIVRPYPYRTHGRVMNQLLLVD
LNKRGEKKKGLTIVTTSFDGYLYLIDGPTSCTDVVDIGETSYSMVLADNV
*DGGDD*LDLIVSTMNGNVFCFSTPSPHHPLKAWRSSDQGRNNKANRYDREG
VFVTHSTRGFRDEEGKNFWAEIEIVDKYRYPSGSQAPYNVTTTLLVPGNY
QGERRITQSQIYDRPGKYRIKLPTVGVRTTGTVMVEMADKNGLHFSDEFS
LTFHMYYYKLLKWLLVLPMLGMFGLLVILRPQEAVPLPSFSRNTDL

FIGURE 6

CLUSTAL W (1.83) multiple sequence alignment

```
SEQID55    MRKRDLAILMLSGFAIFFT-------------------LQHEGDFAFKEAWFHLY
SEQID59    MRKRDLGILLLAAFAVFFS-------------------LQHDGDLSFREAWYHLS
SEQID46    MKSRARQCLLVCLLCLSLTNLSYGE---NKFRERKATDDELGYPDIDEDALLNTQCPKKL
SEQID57    MRPLLAFAAVCALLVAAAAPAAAEEEKANKFRQREATDDMLGYPHLDEDALLKTKCPKHV
              *:      :  : :                            . :*  :.     :

SEQID55    D-EYPVKYEADRLPPPIVADLNGDGKKEVLVATNDAKIQVLEPHSR--RVDEGFSEARVL
SEQID59    DADYPIKHDADRLPSPLVADLNGDGKPEVLIPTHDAKIQVLQPHPRPSPDDASFHDARLM
SEQID46    ELRWQTEVTSSVYATPLIADINSDGKLDIVVPSFVHYLEVLEGADGDKMPGWPAFHQSNV
SEQID57    ELRWQTEVSSSIYATPLIADINSDGKLEVVVPSFVHYLEVLEGSDGDKLPGWPAFHQSNV
             :   :   :  ..*::**:.***  :::.. :    ::**:       .    .   :

SEQID55    AEITLLPDKIRVASGRRAVAMATGVIDRYYKNG-TPQKQVVV---VVTSGWSVLCFDHNL
SEQID59    ADVSLLPSNVRLSSGRRPVAMAVGTVDRHYAHAPSPSKQLLV---VVTSGWSVMCFDHNL
SEQID46    HSSPLLFDIDKDGVREIALATYNAEVLFFRVSGFLMSDKLEVPRRKVHKNWHVGLNPDPV
SEQID57    HSSPLLYDIDKDGTREIVLATYNGVVNFFRVSGYMMMDKLEVPRRKVHKDWYVGLNTDPV
            . .  *: .   :..  :   *   :  *  .   .:: *         .:*    . *

SEQID55    KKLWETNLQEDFPHNAHHREIAISISN---------------------------
SEQID59    KKLWEANLQDDFPHAAHBREVAISITN---------------------------
SEQID46    DRSHPDVHDDVLEEEAMAMKSSTTQTNATTTTPNVTVSMTKEVHGANSYVSTQEDQKRPE
SEQID57    DRSHPDVHDSSIAKKAASEESHPNIQDKPVVNE---------------SSKESQSRST
             . :   :. : .  *    :  .   :
```

FIGURE 7

```
SEQID55   ----------------YTLKHGDTGLVIVG--------------------------
SEQID59   ----------------YTLKHGDAGLVIVG--------------------------
SEQID46   NNQTEAIVKPTPELHNSSMDAGANNLAANATTAGSRENLNRNVTTNEVDQSKISGDKNET
SEQID57   NDSTTRGVD--------SMKHASKEEPVESKPNSTRGQENMDVLNNLN------------
                  ::.  .                         .

SEQID55   ------------------------------GRMEMQPYNHMDPFEELGMTAQNADQHRRS
SEQID59   ------------------------------GRMEMQ-HHSAELFDEFMVSEHNREEHRRS
SEQID46   VIKLNTSTGNSSETLGTSGNSSTAETVTKSGRRLLEEDGSKESVDSHSDSKDNSEGVRMA
SEQID57   ----STDAGNNS------SLSTTTENASHVQRRLLQTDEKSNQAGSSETDASDTGTAKAA
                                          *   ::    :   .   :   : :

SEQID55   ATEN----QASEDSGAINLRHFSVYAFAGKTGLLRWSKKTDDVEAHTSDASQLIPQHNYK
SEQID59   ASEK----QAS-ETGNTDLRHFALYAFAGRTGELRWSRKNENIPSQPSDASVLIPQHNYK
SEQID46   TVENDGGLEADADSSFELLRENDELADEYSYDYDDYVDEKMWGDEEWVEGQHENSEDYVN
SEQID57   TVENSEPLEADADASFNLFRDVEDLPDEYNYDYDDYVDETMWGDEDWKEQQHEKAEDYVS
          : *:     :*. ::.    :*.       .       ::    :    .:.  .

SEQID55   LDVHALNSRHPGEFECREFRESILSVMPHRWDRREDTLLKLAHFR---------------
SEQID59   LDAHALNSRHPGQFECREFRESVLGVMPHHWDRREDTFLQLAHFR---------------
SEQID46   IDAHILCTPVIADIDKDGVQEMIVAVSYFFDPEYYDNPEHLKELGGIDIKNYIASSIVVF
SEQID57   IDAHILSTPVIADIDRDGIQEMVISVSYFFDHEYYDKPEHLKELGGIDIGKYIASSIVVF
          :*.* * :    .:::    ..:* ::.*  .    . *. :* .:

SEQID55   ----RHKRKTLKKQAGSKSTAYPFHKPEEHTPAGKDLSRKIPKLIGKAARYAGSAKPKKG
SEQID59   ----RHKRKALKKTPG-KAVVNNVHKPSEHNPPGKDVSNRLANVIGKAADMANSNKIKKS
SEQID46   NLDTKQVKWIKELDLSTDKANFRAYIYSSPTVVDLDGDGYLDILVGTSFGLFYAMDHRGN
SEQID57   NLDTRQVKWTAELDLSTDSGNFTAHAYSSPTVVDLDGDGNLDILVGTSFGLFYVIDHRGK
              ::  :     :   ..      :  ... . *  .   :  ::*.:      . :

SEQID55   --MQYIPTITNYTKLWWVPNV-------VVAHQKEGIEAIHLPTGRTLCKLSLL----EG
SEQID59   QRTLYVPTITNYTQVWWVPNV-------VVAHEKEGIEAVHLASGRTICKLHLT----EG
SEQID46   IREKFPLEMAEIQGAVVAADINDDGKIELVTTDSHGNIAAWTTQGVEIWEAHLKSLVPQG
SEQID57   VRNKFPLEMAEIHAPVIAADINDDGKIEMVTADVHGNVAAWTAEGEEIWEVHLKSLIPQR
              :   :::       ..:: ::*: :.* *  .*  ::  *     :

SEQID55   GLHADINGDG-VLDHVQTVGGNVGERTVVSGS----------MEVLKPCWAVATSGVPIR
SEQID59   GLHADINGDG-VLDHVQVVGANGIEQTVVSGS----------MEVLKPCWAVATSGVPVR
SEQID46   PSIGDVDGDGHTEVVVPTSSGNIYVLSGKDGSIVRPYPYRTHGRVMNQLLLVDLNKRGEK
SEQID57   PTVGDVNGDGRTEVVVPTVSGNIYVLSGKDGSKIQPFPYRTHGRIMSPVLLLDMSKHDEK
           .*:;:***   *   ..*   :  .**         .::.   :     :    :

SEQID55   EQLFNVSICHHSPFNFLHYGGDYSRHFAQARDTSTLEIATPILIPRDDGHKHRKGSHGDV
SEQID59   EQLFNVSICHYNNFNLFHHG-DFSRSFGRTFDTTGLEVATPILLQRDDGHKHRRGSHGDI
SEQID46   KKGLTIVTTSFDGYLYLIDGPTSCTDVVDIGETSYSMVLADNVDGGDDLDLIVSTMNGNV
SEQID57   SKGLTLATTSFDGYLYLIEGSSGCADVVDIGETSYSMVLADNVDGGDDLDLIVTTMNGNV
           .: :.:    .. : :    * .  .    :*:   : : :  ** .       :*::

SEQID55   IFLTN----------RGEVTSYTPDVHGHDAVWQWQLQTEATWSNLPSPSGLTESGTVVP
SEQID59   IFLTS----------RGEVTSYSPGLLGHDAIWRWQLSTGATWSNLPSPSGMMEN-IVVP
SEQID46   FCFSTPSSHHPLKAWRSSDQGRNNKANRYDREGVFVTHSTRGFRDEEGKNFWAEIEIVDK
SEQID57   FCFSTPSPHHPLKEWRSSNQGRNNAAYRYNREGIYVKHGSRTFRDEEGKHFWVEFEIVDK
          : ::.          *..  .     ::     :     : .      * *
```

FIGURE 7 (continued)

```
SEQID55    TLKPFSLRIHD--NQPMILAGGDQAAVIISPGGSILASIELPSQPTHALITDDFSNDGLT
SEQID59    TLKAFSLRAYD--PKQVIIAGGDLEAVVISPSGGLLASIELPAPPTHALVLEDFNGDGLT
SEQID46    YRYPSGSQAPYNVTTTLLVPGNYQGERRITQS----QIYDRPGKYRIKLPTVGVRTTGTV
SEQID57    YRVPYGNQAPYNVTVTLLVPGNYQGERRIVVN----AAYNEPGKQRMKLPTVPVRTTGTV
             . :        :::.*.      *    .      :*.   *   .  *  .

SEQID55    DVIVMTSNGVYGFVQTRQPGALFFSSLVGCLLVVMAV-IFVTQHLNSIQ-GKPRPSSSF-
SEQID59    DIILVTSGGVYGFVQTRHPGALFFSTLVGCLIVVIGV-IFVSLHLNSSNSGKPRASTDYR
SEQID46    MVEMADKNGLHFSDEFSLTFHMYYYKLLKWLLVLPMLGMFGLLVILRPQEAVPLPSFSRN
SEQID57    LVEMVDKNGFYFSDEFSLTFHMHYYKLLKWLVLLPMLGMFSVLVILRPQEGAPLPSFSRN
           : :  ..*.:     :    .:.  .*:   *::: :   :*    :  :. * .* .

SEQID55    ---
SEQID59    ---
SEQID46    TDL
SEQID57    ID-
```

FIGURE 7 (continued)

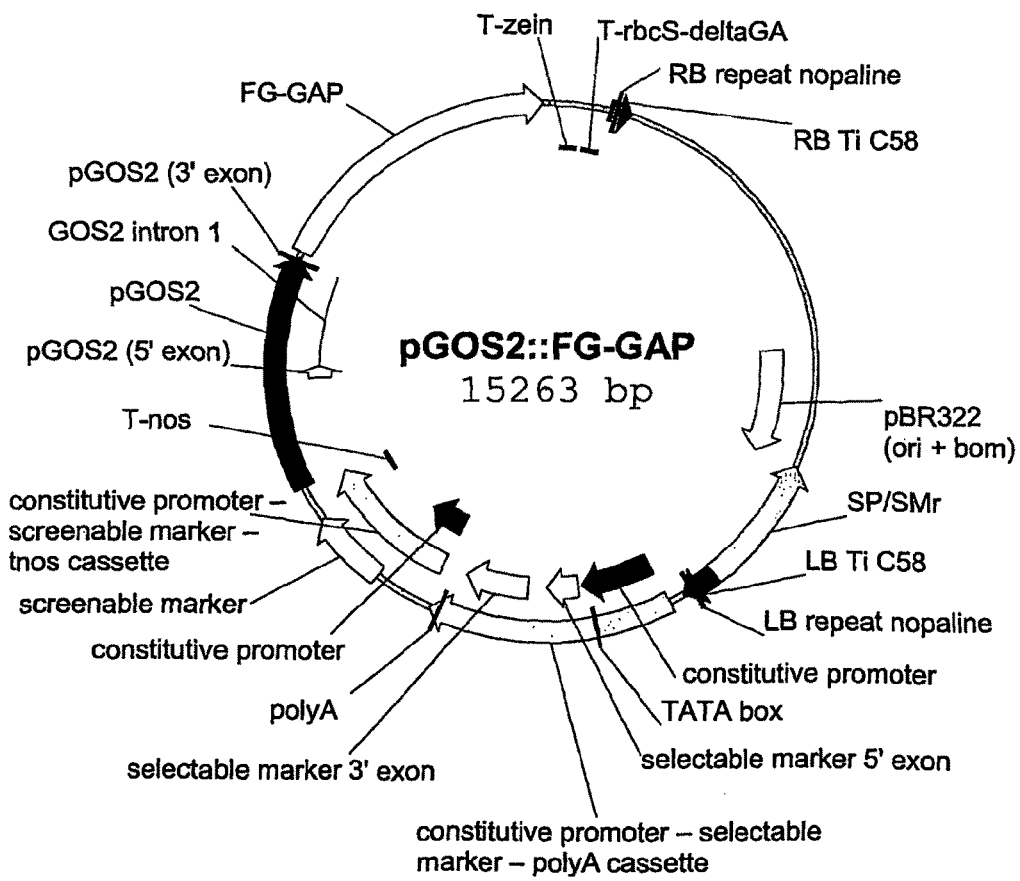

FIGURE 8

SEQ ID NO: 45, AtFG-GAP coding sequence
ATGAGCAATGCTTTTTTATAATGCCAACTTTGTACAAAAAAGCAGGCTTAAACAATGAAATC
TCGAGCGAGGCAGTGTCTGCTGGTTTGTTTGCTCTGTCTTTCCTTAACGAATCTCTCCTATG
GAGAAAATAAGTTCAGAGAGCGTAAAGCCACCGATGACGAGCTGGGCTACCCCGATATTGAT
GAAGATGCTTTATTGAATACTCAGTGCCCGAAAAAATTGGAGCTGCGATGGCAAACTGAAGT
CACTTCTAGCGTTTATGCTACACCCTTGATTGCTGATATTAACAGTGATGGAAAGCTTGACA
TTGTTGTTCCATCTTTTGTTCATTACCTCGAAGTTCTTGAAGGAGCTGATGGAGACAAGATG
CCAGGTTGGCCTGCTTTTCACCAGTCAAATGTGCACTCGAGTCCTCTTCTATTTGATATCGA
CAAAGATGGTGTTAGAGAAATTGCTCTGGCTACCTACAATGCCGAAGTGCTCTTTTTCAGGG
TATCAGGCTTTTTGATGTCAGATAAGCTAGAAGTGCCACGTAGAAAAGTGCACAAGAACTGG
CATGTGGGACTTAATCCTGATCCTGTTGACCGTTCACATCCTGATGTTCATGATGATGTGCT
TGAGGAGGAAGCTATGGCAATGAAGTCATCGACCACTCAAACGAATGCAACTACCACAACAC
CAAATGTTACAGTCTCGATGACCAAAGAAGTTCATGGCGCTAATTCATATGTGTCAACTCAA
GAGGATCAAAAGAGACCAGAGAATAATCAAACAGAAGCTATTGTAAAGCCTACTCCAGAGCT
ACATAATTCCTCCATGGATGCTGGAGCAAATAATTTGGCAGCAAATGCTACTACAGCTGGCT
CAAGAGAAAACCTCAATAGAAATGTAACCACCAATGAGGTGGATCAAAGCAAAATTAGTGGA
GATAAGAATGAAACTGTTATTAAATTAAATACTAGTACGGGTAATTCCTCAGAAACTCTGGG
GACATCTGGAAACAGTAGTACGGCAGAGACAGTAACCAAAAGTGGGAGGCGACTTCTGGAAG
AGGATGGTTCGAAAGAATCTGTGGACAGCCATTCGGACAGTAAAGACAACAGTGAGGGTGTC
CGCATGGCGACAGTAGAAAATGATGGAGGCTTAGAAGCTGACGCAGATTCATCGTTTGAGTT
GTTGCGTGAGAATGATGAGTTAGCTGATGAATACAGTTATGATTATGACGATTATGTTGATG
AGAAAATGTGGGGTGATGAGGAATGGGTTGAGGGGCAGCACGAGAACTCAGAAGATTATGTG
AATATTGACGCCCATATACTATGCACTCCTGTAATTGCTGACATAGACAAAGATGGAGTACA
GGAGATGATTGTTGCTGTTTCCTATTTCTTCGACCCCGAGTACTATGATAATCCAGAACATC
TGAAAGAGCTTGGTGGTATCGACATTAAAAATTATATTGCTAGTTCAATTGTGGTTTTCAAT
CTTGATACTAAACAAGTCAAGTGGATCAAAGAGCTAGATTTGAGTACGGATAAAGCAAACTT
CCGTGCTTATATTTATTCTTCACCAACGGTTGTTGATTTGGATGGCGATGGTTATTTGGATA
TCCTTGTCGGAACTTCCTTTGGCTTATTCTACGCCATGGATCATCGTGGAAACATCAGAGAA
AAATTCCCACTGGAAATGGCTGAAATTCAAGGAGCAGTGGTTGCGGCCGACATAAATGATGA
TGGAAAGATTGAACTTGTAACTACTGATTCACACGGAAATATAGCAGCATGGACCACCCAAG
GAGTGGAAATTTGGGAAGCACATCTTAAGAGCCTTGTTCCCCAGGGTCCTTCTATAGGCGAT
GTTGATGGTGACGGACACACGGAGGTTGTGGTTCCTACATCATCAGGAAACATATACGTTCT
TAGTGGCAAGGATGGTTCTATTGTCCGTCCTTACCCATACAGGACTCATGGAAGAGTGATGA
ACCAACTTCTTCTTGTTGATCTGAACAAGCGAGGTGAGAAAAAGAAGGGTCTCACCATCGTT
ACTACATCCTTTGACGGTTACCTGTATCTCATAGATGGACCCACCTCGTGCACTGACGTTGT
TGACATTGGCGAAACTTCATACAGCATGGTCTTGGCTGATAATGTTGACGGTGGAGATGATC
TCGATCTTATTGTCTCAACTATGAATGGAAACGTCTTTTGCTTCTCAACGCCTTCTTCTCAC
CATCCCCTTAAGGCTTGGAGATCTAGTGATCAAGGCAGGAACAATAAGGCCAATCGTTATGA
TCGTGAAGGCGTTTTTGTCACGCATTCGACCAGAGGTTTCCGTGATGAGGAAGGCAAAAACT
TCTGGGCTGAGATCGAGATCGTTGATAAATATAGATATCCATCTGGTTCACAAGCACCCTAC
AACGTTACTACGACGCTGTTGGTTCCAGGCAATTACCAGGGAGAGAGGAGGATAACGCAGAG
CCAGATCTATGACCGCCCTGGAAAATACCGGATAAAACTACCAACTGTGGGAGTGAGAACAA
CAGGAACTGTAATGGTGGAGATGGCAGATAAGAATGGACTCCATTTCTCAGACGAATTCTCA
CTAACTTTCCATATGTATTACTACAAGCTTCTGAAATGGCTTCTTGTTCTCCCGATGCTCGG
GATGTTCGGTCTGCTCGTGATACTACGGCCTCAAGAAGCCGTGCCTCTCCCGTCTTTTTCCC
GCAACACAGATTTATGA

FIGURE 9

SEQ ID NO: 46, AtFG-GAP deduced protein sequence
MKSRARQCLLVCLLCLSLTNLSYGENKFRERKATDDELGYPDIDEDALLNTQCPKKLELR
WQTEVTSSVYATPLIADINSDGKLDIVVPSFVHYLEVLEGADGDKMPGWPAFHQSNVHSS
PLLFDIDKDGVREIALATYNAEVLFFRVSGFLMSDKLEVPRRKVHKNWHVGLNPDPVDRS
HPDVHDDVLEEEAMAMKSSTTQTNATTTTPNVTVSMTKEVHGANSYVSTQEDQKRPENNQ
TEAIVKPTPELHNSSMDAGANNLAANATTAGSRENLNRNVTTNEVDQSKISGDKNETVIK
LNTSTGNSSETLGTSGNSSTAETVTKSGRRLLEEDGSKESVDSHSDSKDNSEGVRMATVE
NDGGLEADADSSFELLRENDELADEYSYDYDDYVDEKMWGDEEWVEGQHENSEDYVNIDA
HILCTPVIADIDKDGVQEMIVAVSYFFDPEYYDNPEHLKELGGIDIKNYIASSIVVFNLD
TKQVKWIKELDLSTDKANFRAYIYSSPTVVDLDGDGYLDILVGTSFGLFYAMDHRGNIRE
KFPLEMAEIQGAVVAADINDDGKIELVTTDSHGNIAAWTTQGVEIWEAHLKSLVPQGPSI
GDVDGDGHTEVVVPTSSGNIYVLSGKDGSIVRPYPYRTHGRVMNQLLLVDLNKRGEKKKG
LTIVTTSFDGYLYLIDGPTSCTDVVDIGETSYSMVLADNVDGGDDLDLIVSTMNGNVFCF
STPSSHHPLKAWRSSDQGRNNKANRYDREGVFVTHSTRGFRDEEGKNFWAEIEIVDKYRY
PSGSQAPYNVTTTLLVPGNYQGERRITQSQIYDRPGKYRIKLPTVGVRTTGTVMVEMADK
NGLHFSDEFSLTFHMYYYKLLKWLLVLPMLGMFGLLVILRPQEAVPLPSFSRNTDL SEQ ID NO: 47, prm06643, start codon in bold, AttB1 site in
italics
*GGGGACAAGTTTGTACAAAAAAGCAGGCTTAAACA*ATGAAATCTCGAGCGAGG SEQ ID NO: 48, prm06644, reverse, complementary, AttB2 site in
italic
*GGGGACCACTTTGTACAAGAAAGCTGGGT*CCTGTTTACAGATGGTACCTAGT SEQ ID NO: 49, FG-GAP expression cassette with the promoter-
gene combination, promoter sequence in italics, start and stop
codon of the FG-GAP ORF in bold and underlined
*AATCCGAAAAGTTTCTGCACCGTTTTCACCCCCTAACTAACAATATAGGGAACGTGTGCTAA*
*ATATAAAATGAGACCTTATATATGTAGCGCTGATAACTAGAACTATGCAAGAAAAACTCATC*
*CACCTACTTTAGTGGCAATCGGGCTAAATAAAAAAGAGTCGCTACACTAGTTTCGTTTTCCT*
*TAGTAATTAAGTGGGAAAATGAAATCATTATTGCTTAGAATATACGTTCACATCTCTGTCAT*
*GAAGTTAAATTATTCGAGGTAGCCATAATTGTCATCAAACTCTTCTTGAATAAAAAAATCTT*
*TCTAGCTGAACTCAATGGGTAAAGAGAGAGATTTTTTTAAAAAAATAGAATGAAGATATTC*
*TGAACGTATTGGCAAAGATTTAAACATATAATTATATAATTTTATAGTTTGTGCATTCGTCA*
*TATCGCACATCATTAAGGACATGTCTTACTCCATCCCAATTTTTATTTAGTAATTAAAGACA*
*ATTGACTTATTTTTATTATTTATCTTTTTTCGATTAGATGCAAGGTACTTACGCACACACTT*
*TGTGCTCATGTGCATGTGTGAGTGCACCTCCTCAATACACGTTCAACTAGCAACACATCTCT*
*AATATCACTCGCCTATTTAATACATTTAGGTAGCAATATCTGAATTCAAGCACTCCACCATC*
*ACCAGACCACTTTTAATAATATCTAAAATACAAAAAATAATTTTACAGAATAGCATGAAAAG*
*TATGAAACGAACTATTTAGGTTTTTCACATACAAAAAAAAAAAGAATTTTGCTCGTGCGCGA*
*GCGCCAATCTCCCATATTGGGCACACAGGCAACAACAGAGTGGCTGCCCACAGAACAACCCA*
*CAAAAAACGATGATCTAACGGAGGACAGCAAGTCCGCAACAACCTTTTAACAGCAGGCTTTG*
*CGGCCAGGAGAGAGGAGGAGAGGCAAAGAAAACCAAGCATCCTCCTCCTCCCATCTATAAAT*
*TCCTCCCCCCTTTTCCCCTCTCTATATAGGAGGCATCCAAGCCAAGAAGAGGGAGAGCACCA*
*AGGACACGCGACTAGCAGAAGCCGAGCGACCGCCTTCTTCGATCCATATCTTCCGGTCGAGT*
*TCTTGGTCGATCTCTTCCCTCCTCCACCTCCTCCTCACAGGGTATGTGCCCTTCGGTTGTTC*
*TTGGATTTATTGTTCTAGGTTGTGTAGTACGGGCGTTGATGTTAGGAAAGGGGATCTGTATC*

FIGURE 9 (continued)

```
TGTGATGATTCCTGTTCTTGGATTTGGGATAGAGGGGTTCTTGATGTTGCATGTTATCGGTT
CGGTTTGATTAGTAGTATGGTTTTCAATCGTCTGGAGAGCTCTATGGAAATGAAATGGTTTA
GGGTACGGAATCTTGCGATTTTGTGAGTACCTTTTGTTTGAGGTAAAATCAGAGCACCGGTG
ATTTTGCTTGGTGTAATAAAAGTACGGTTGTTTGGTCCTCGATTCTGGTAGTGATGCTTCTC
GATTTGACGAAGCTATCCTTTGTTTATTCCCTATTGAACAAAAATAATCCAACTTTGAAGAC
GGTCCCGTTGATGAGATTGAATGATTGATTCTTAAGCCTGTCCAAAATTTCGCAGCTGGCTT
GTTAGATACAGTAGTCCCCATCACGAAATTCATGGAAACAGTTATAATCCTCAGGAACAGG
GGATTCCCTGTTCTTCCGATTTGCTTTAGTCCCAGAATTTTTTTCCCAAATATCTTAAAAA
GTCACTTTCTGGTTCAGTTCAATGAATTGATTGCTACAAATAATGCTTTTATAGCGTTATCC
TAGCTGTAGTTCAGTTAATAGGTAATACCCCTATAGTTTAGTCAGGAGAAGAACTTATCCGA
TTTCTGATCTCCATTTTTAATTATATGAAATGAACTGTAGCATAAGCAGTATTCATTTGGAT
TATTTTTTTTATTAGCTCTCACCCCTTCATTATTCTGAGCTGAAAGTCTGGCATGAACTGTC
CTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAA
TCGGGATAGTTATACTGCTTGTTCTTATGATTCATTTCCTTTGTGCAGTTCTTGGTGTAGCT
TGCCACTTTCACCAGCAAAGTTCATTTAAATCAACTAGGGATATCACAAGTTTGTACAAAAA
AGCAGGCTTAAACAATGAAATCTCGAGCGAGGCAGTGTCTGCTGGTTTGTTTGCTCTGTCTT
TCCTTAACGAATCTCTCCTATGGAGAAAATAAGTTCAGAGAGCGTAAAGCCACCGATGACGA
GCTGGGCTACCCCGATATTGATGAAGATGCTTTATTGAATACTCAGTGCCCGAAAAAATTGG
AGCTGCGATGGCAAACTGAAGTCACTTCTAGCGTTTATGCTACACCCTTGATTGCTGATATT
AACAGTGATGGAAAGCTTGACATTGTTGTTCCATCTTTTGTTCATTACCTCGAAGTTCTTGA
AGGAGCTGATGGAGACAAGATGCCAGGTTGGCCTGCTTTTCACCAGTCAAATGTGCACTCGA
GTCCTCTTCTATTTGATATCGACAAAGATGGTGTTAGAGAAATTGCTCTGGCTACCTACAAT
GCCGAAGTGCTCTTTTTCAGGGTATCAGGCTTTTTGATGTCAGATAAGCTAGAAGTGCCACG
TAGAAAAGTGCACAAGAACTGGCATGTGGGACTTAATCCTGATCCTGTTGACCGTTCACATC
CTGATGTTCATGATGATGTGCTTGAGGAGGAAGCTATGGCAATGAAGTCATCGACCACTCAA
ACGAATGCAACTACCACAACACCAAATGTTACAGTCTCGATGACCAAAGAAGTTCATGGCGC
TAATTCATATGTGTCAACTCAAGAGGATCAAAAGAGACCAGAGAATAATCAAACAGAAGCTA
TTGTAAAGCCTACTCCAGAGCTACATAATTCCTCCATGGATGCTGGAGCAAATAATTTGGCA
GCAAATGCTACTACAGCTGGCTCAAGAGAAAACCTCAATAGAAATGTAACCACCAATGAGGT
GGATCAAAGCAAAATTAGTGGAGATAAGAATGAAACTGTTATTAAATTAAATACTAGTACGG
GTAATTCCTCAGAAACTCTGGGGACATCTGGAAACAGTAGTACGGCAGAGACAGTAACCAAA
AGTGGGAGGCGACTTCTGGAAGAGGATGGTTCGAAAGAATCTGTGGACAGCCATTCGGACAG
TAAAGACAACAGTGAGGGTGTCCGCATGGCGACAGTAGAAAATGATGGAGGCTTAGAAGCTG
ACGCAGATTCATCGTTTGAGTTGTTGCGTGAGAATGATGAGTTAGCTGATGAATACAGTTAT
GATTATGACGATTATGTTGATGAGAAATGTGGGGTGATGAGGAATGGGTTGAGGGGCAGCA
CGAGAACTCAGAAGATTATGTGAATATTGACGCCCATATACTATGCACTCCTGTAATTGCTG
ACATAGACAAAGATGGAGTACAGGAGATGATTGTTGCTGTTTCCTATTTCTTCGACCCCGAG
TACTATGATAATCCAGAACATCTGAAAGAGCTTGGTGGTATCGACATTAAAAATTATATTGC
TAGTTCAATTGTGGTTTTCAATCTTGATACTAAACAAGTCAAGTGGATCAAAGAGCTAGATT
TGAGTACGGATAAAGCAAACTTCCGTGCTTATATTTATTCTTCACCAACGGTTGTTGATTTG
GATGGCGATGGTTATTTGGATATCCTTGTCGGAACTTCCTTTGGCTTATTCTACGCCATGGA
TCATCGTGGAAACATCAGAGAAAAATTCCCACTGGAAATGGCTGAAATTCAAGGAGCAGTGG
TTGCGGCCGACATAAATGATGATGGAAAGATTGAACTTGTAACTACTGATTCACACGGAAAT
ATAGCAGCATGGACCACCCAAGGAGTGGAAATTTGGGAAGCACATCTTAAGAGCCTTGTTCC
CCAGGGTCCTTCTATAGGCGATGTTGATGGTGACGGACACACGGAGGTTGTGGTTCCTACAT
CATCAGGAAACATATACGTTCTTAGTGGCAAGGATGGTTCTATTGTCCGTCCTTACCCATAC
```

FIGURE 9 (continued)

```
AGGACTCATGGAAGAGTGATGAACCAACTTCTTCTTGTTGATCTGAACAAGCGAGGTGAGAA
AAAGAAGGGTCTCACCATCGTTACTACATCCTTTGACGGTTACCTGTATCTCATAGATGGAC
CCACCTCGTGCACTGACGTTGTTGACATTGGCGAAACTTCATACAGCATGGTCTTGGCTGAT
AATGTTGACGGTGGAGATGATCTCGATCTTATTGTCTCAACTATGAATGGAAACGTCTTTTG
CTTCTCAACGCCTTCTCCTCACCATCCCCTTAAGGCTTGGAGATCTAGTGATCAAGGCAGGA
ACAATAAGGCCAATCGTTATGATCGTGAAGGCGTTTTTGTCACGCATTCGACCAGAGGTTTC
CGTGATGAGGAAGGCAAAAACTTCTGGGCTGAGATCGAGATCGTTGATAAATATAGATATCC
ATCTGGTTCACAAGCACCCTACAACGTTACTACGACGCTGTTGGTTCCAGGCAATTACCAGG
GAGAGAGGAGGATAACGCAGAGCCAGATCTATGACCGCCTGGAAAATACCGGATAAAACTA
CCAACTGTGGGAGTGAGAACAACAGGAACTGTAATGGTGGAGATGGCAGATAAGAATGGACT
CCATTTCTCAGACGAATTCTCACTAACTTTCCATATGTATTACTACAAGCTTCTGAAATGGC
TTCTTGTTCTCCCGATGCTCGGGATGTTCGGTCTGCTCGTGATACTACGGCCTCAAGAAGCC
GTGCCTCTCCCGTCTTTTTCCCGCAACACAGATTTATGAT
```

SEQ ID NO: 50, conserved motif 1
FDGYLYLI(D/E)G

SEQ ID NO: 51, conserved motif 2
DGXX(D/E)

SEQ ID NO: 52, conserved motif 3
DXDXDGXX(D/E)

SEQ ID NO: 53: FG-GAP domain conserved sequence
ggssvaagDlnGDGrpDlvvgaPgadggtdgsvyll

SEQ ID NO: 54, AtFG-GAP homologue 1, coding sequence (NM_114965)
```
ATTCTTCATCGTTCTCTCTGCTCTGGTAAGGAGATTGCTGCTACCTACTGATGCAAATCTGC
CATTGATACATCTGCTTGCGGTTAGGGCAAAGATGAGGAAACGCGATTTGGCTATTTTGATG
CTCTCTGGATTTGCTATATTCTTCACTCTTCAGCACGAGGGTGATTTTGCGTTCAAAGAAGC
ATGGTTTCATTTGTATGATGAATACCCAGTCAAATACGAAGCTGATCGTCTCCCACCACCTA
TTGTAGCTGATCTTAATGGTGATGGAAAGAAGGAGGTTCTCGTTGCTACTAATGATGCCAAA
ATTCAGGTTCTGGAGCCTCATTCCAGGCGTGTGGATGAAGGTTTTAGTGAAGCACGTGTTCT
TGCGGAAATCACTCTTTTGCCTGACAAGATCCGTGTTGCGTCAGGGAGACGTGCTGTGGCCA
TGGCCACAGGTGTTATTGATAGGTACTATAAAAATGGAACTCCCCAGAAGCAGGTTGTGGTC
GTTGTTACCTCAGGTTGGTCTGTGCTCTGCTTTGATCACAACCTGAAAAAGCTGTGGGAAAC
GAATCTGCAGGAGGATTTCCCACATAATGCACACCATAGAGAGATAGCAATTTCGATAAGCA
ATTACACATTGAAGCATGGTGATACGGGTTTGGTTATTGTTGGTGGACGGATGGAGATGCAG
CCATATAATCACATGGACCCATTTGAGGAACTTGGCATGACAGCACAAAATGCTGATCAACA
CAGAAGAAGTGCTACTGAGAATCAGGCCTCTGAAGATTCTGGAGCCATAAACTTGCGTCACT
TTTCTGTCTATGCATTTGCTGGCAAGACTGGCCTTCTTCGATGGAGTAAAAAGACTGATGAT
GTTGAAGCTCACACCTCAGATGCATCACAATTAATTCCACAACACAATTACAAGCTTGATGT
GCATGCTCTAAATAGCCGTCACCCAGGAGAGTTTGAGTGCAGGGAATTTAGAGAATCAATTC
TTAGTGTCATGCCCCATCGCTGGGACCGACGTGAAGATACATTATTGAAGCTTGCTCATTTC
AGGCGACACAAGAGGAAAACATTGAAGAAGCAGGCTGGTAGTAAGTCTACAGCTTATCCGTT
TCACAAACCTGAGGAACACACACCCGCTGGAAAGGACTTGTCAAGAAAGATTCCAAAATTGA
```

```
TTGGAAAGGCTGCACGCTATGCTGGCTCGGCAAAACCCAAGAAGGGTATGCAATACATTCCG
ACGATAACTAATTACACGAAGCTTTGGTGGGTTCCTAATGTTGTTGTGGCTCATCAAAAGGA
AGGAATTGAAGCTATTCATTTGCCTACTGGTCGAACACTTTGCAAGCTTTCTCTACTTGAAG
GTGGACTTCACGCCGACATAAACGGAGATGGTGTTCTCGATCATGTCCAGACTGTCGGAGGC
AATGTTGGAGAGAGAACTGTAGTGAGCGGGTCAATGGAAGTGTTGAAGCCTTGCTGGGCAGT
GGCAACCTCAGGCGTTCCCATCCGGGAACAGCTCTTTAACGTCTCGATCTGCCATCACTCCC
CTTTTAACTTCTTGCACTATGGAGGAGATTACTCACGACACTTCGCCCAGGCAAGAGACACC
TCTACTCTGGAGATCGCAACTCCCATTCTCATCCCCAGAGATGATGGACACAAACACCGCAA
AGGCAGTCACGGAGATGTAATCTTCTTGACAAACCGTGGAGAGGTGACATCATACACGCCTG
ATGTGCACGGCCACGACGCAGTCTGGCAATGGCAGCTTCAGACAGAAGCCACATGGTCGAAT
CTCCCGTCTCCATCGGGTTTAACTGAATCAGGGACGGTGGTCCCAACCCTGAAACCATTCTC
GTTGCGCATTCATGATAACCAGCCTATGATCCTTGCCGGGGAGATCAAGCAGCGGTCATCA
TCTCTCCGGGAGGAAGCATATTGGCTTCCATCGAATTACCGTCTCAACCGACTCATGCACTT
ATCACTGATGACTTCTCGAACGATGGTCTAACGGATGTGATTGTGATGACCTCAAATGGGGT
TTACGGGTTTGTTCAAACCAGACAGCCAGGGGCTCTGTTCTTCAGTTCGTTGGTGGGTTGTC
TCTTAGTAGTTATGGCAGTTATTTTCGTTACTCAGCACTTAAACTCCATTCAAGGTAAGCCT
CGACCATCATCTAGCTTTTAATAGAAATCTCGTAGAGTTTTCTTCCTCTCTACGGAAGTTAA
ACCGGCAGGTCCGCTTTAGCAGCTTCACCCACATCGGTTTTGGTAAACCGGAAATATTACTG
ATATACCAGTGTAGATTCAGTGCCTTATTTCCTGGTTTCAGCTGTATAACTTTATACTTTGT
AGAATTCAAGTAAAAAATGGTAGAGGCAAATAGAGGACTTTATGTTTTTGTCAATTTTGATG
TTTTAATGGAATTATGTGACATTTAATTTAT
```

SEQ ID NO: 55, AtFG-GAP homologue 1, deduced protein sequence (NP_190674)
```
MRKRDLAILMLSGFAIFFTLQHEGDFAFKEAWFHLYDEYPVKYEADRLPPPIVADLNGDGKK
EVLVATNDAKIQVLEPHSRRVDEGFSEARVLAEITLLPDKIRVASGRRAVAMATGVIDRYYK
NGTPQKQVVVVVTSGWSVLCFDHNLKKLWETNLQEDFPHNAHHREIAISISNYTLKHGDTGL
VIVGGRMEMQPYNHMDPFEELGMTAQNADQHRRSATENQASEDSGAINLRHFSVYAFAGKTG
LLRWSKKTDDVEAHTSDASQLIPQHNYKLDVHALNSRHPGEFECREFRESILSVMPHRWDRR
EDTLLKLAHFRRHKRKTLKKQAGSKSTAYPFHKPEEHTPAGKDLSRKIPKLIGKAARYAGSA
KPKKGMQYIPTITNYTKLWWVPNVVVAHQKEGIEAIHLPTGRTLCKLSLLEGGLHADINGDG
VLDHVQTVGGNVGERTVVSGSMEVLKPCWAVATSGVPIREQLFNVSICHHSPFNFLHYGGDY
SRHFAQARDTSTLEIATPILIPRDDGHKHRKGSHGDVIFLTNRGEVTSYTPDVHGHDAVWQW
QLQTEATWSNLPSPSGLTESGTVVPTLKPFSLRIHDNQPMILAGGDQAAVIISPGGSILASI
ELPSQPTHALITDDFSNDGLTDVIVMTSNGVYGFVQTRQPGALFFSSLVGCLLVVMAVIFVT
QHLNSIQGKPRPSSSF
```

SEQ ID NO: 56, OsFG-GAP homologue 1, coding sequence (NM_185137)
```
ATGCGTCCCCTCCTCGCCTTCGCGGCGGTATGCGCCCTTCTCGTGGCTGCCGCAGCGCCGGC
GGCCGCGGAGGAGGAGAAGGCGAACAAGTTCCGGCAGCGCGAGGCCACCGACGACATGCTTG
GATACCCCCACCTTGATGAAGATGCTTTATTGAAGACCAAGTGTCCAAAACATGTAGAGCTG
AGATGGCAGACTGAAGTTAGTTCCAGCATTTATGCAACTCCGTTGATCGCTGATATCAACAG
CGATGGAAAGTTGGAAGTAGTGGTGCCATCATTTGTTCATTACCTGGAAGTTCTTGAAGGCT
CTGATGGGGACAAATTGCCAGGATGGCCTGCATTTCACCAGTCAAATGTTCATTCAAGTCCA
CTTCTATATGATATTGACAAGGACGGGACACGGGAAATAGTTTTGGCAACTTACAATGGTGT
AGTGAATTTCTTCAGGGTATCAGGTTATATGATGATGGACAAGCTAGAAGTACCTCGTAGGA
AGGTACACAAAGACTGGTATGTTGGGCTGAATACAGATCCCGTTGACCGCTCCCATCCAGAT
```

FIGURE 9 (continued)

```
GTTCATGACAGCTCAATTGCAAAGAAAGCTGCTTCTGAAGAATCTCACCCAAATATTCAGGA
CAAGCCAGTTGTGAATGAATCTTCTAAGGAATCCCAGTCACGGAGCACAAATGACTCAACAA
CACGAGGAGTTGATTCCATGAAACATGCGTCTAAGGAAGAGCCAGTTGAAAGTAAACCTAAT
TCTACCCGAGGACAGGAGAATATGGATGTGTTAAACAATCTAAACAGCACAGATGCTGGGAA
CAACTCTAGTTTAAGTACTACAACAGAGAATGCATCACATGTTCAGAGAAGGTTGCTTCAAA
CAGATGAGAAAAGTAATCAAGCAGGAAGCTCAGAAACTGATGCAAGTGATACCGGAACAGCA
AAAGCAGCTACTGTTGAAAATAGCGAGCCTCTAGAGGCTGATGCTGATGCATCATTTAATTT
GTTTCGGGATGTAGAAGATCTGCCTGATGAGTACAATTACGATTATGATGACTACGTTGATG
AAACCATGTGGGGAGACGAGGACTGGAAAGAACAACAACATGAAAAGGCAGAAGATTATGTG
AGCATAGATGCTCACATCTTGTCCACCCCAGTGATTGCAGATATTGACAGAGATGGCATACA
AGAAATGGTGATTTCTGTATCTTACTTCTTTGACCACGAGTATTATGATAAACCAGAACATC
TAAAGGAGTTAGGAGGGATTGACATTGGCAAATATATTGCAAGCAGTATAGTTGTTTTTAAC
CTTGACACAAGACAAGTCAAATGGACTGCAGAACTTGATTTGAGTACAGATAGTGGAAATTT
TACTGCCCATGCATATTCTTCGCCGACCGTGGTTGATTTGGATGGTGATGGAAATTTGGATA
TTCTTGTTGGAACTTCCTTTGGCTTGTTTTATGTTATCGATCATCGTGGTAAGGTTAGGAAC
AAGTTCCCACTTGAGATGGCGGAGATTCATGCACCAGTCATTGCAGCAGATATCAATGATGA
TGGGAAAATCGAGATGGTCACTGCTGATGTCCATGGCAATGTAGCAGCATGGACTGCAGAGG
GAGAAGAAATCTGGGAGGTTCATCTTAAGAGTCTTATCCCACAGCGCCCTACTGTTGGTGAT
GTTAATGGAGATGGTCGCACTGAAGTTGTGGTCCCAACCGTGTCAGGAAACATATATGTTCT
TAGTGGAAAGGATGGCTCAAAAATTCAGCCTTTCCCATATAGAACGCATGGAAGGATCATGA
GTCCTGTTCTATTGCTTGACATGAGCAAACATGATGAAAAGTCTAAAGGCCTCACCCTTGCT
ACTACATCCTTTGATGGTTACTTGTATTTGATTGAGGGCTCAAGTGGCTGTGCAGATGTTGT
TGACATTGGAGAGACCTCGTACAGTATGGTTTTGGCTGATAATGTTGATGGTGGAGATGACC
TCGATCTTATTGTTACTACCATGAATGGCAATGTCTTCTGCTTCTCCACTCCCTCTCCGCAC
CATCCACTTAAGGAATGGAGATCATCAAACCAGGGAAGAAACAATGCTGCATATCGTTACAA
CCGTGAAGGTATTTATGTTAAACACGGTTCCAGAACATTCCGTGACGAAGAGGGCAAGCATT
TCTGGGTAGAGTTTGAGATTGTGGACAAGTACAGGGTTCCTTATGGGAACCAAGCTCCTTAT
AACGTGACGGTTACTCTACTTGTCCCTGGGAATTATCAAGGAGAAAGGCGCATTGTGGTTAA
TGCAGCTTATAATGAACCAGGCAAGCAGCGGATGAAGCTTCCCACAGTTCCTGTGAGAACCA
CAGGAACTGTGCTTGTGGAAATGGTTGACAAAAACGGGTTCTACTTCTCTGACGAGTTCTCG
CTCACCTTCCACATGCATTATTACAAGCTTCTGAAATGGCTCGTGCTTCTTCCAATGCTTGG
GATGTTTAGCGTTCTTGTCATCCTGCGGCCACAAGAAGGCGCTCCGTTGCCATCATTTTCAA
GGAATATTGATTAGTGATTTGCACAGTGAAACGTCAGGTCCTCATAGAAGCAGATAAGCAGA
ACAAGATATTAGCAGGATATCCAATCACCCATGAAGGAGCTTGTCCACATCATACTGCATCG
GGGAGCTCAATCTGCACAGAAAAAACCCCTCACGATGCTGCATCCCATCAGTTAGCTAGTTC
GGGAAGTACAGCTTTTAGTCATGCAAAAGAATTTTGTCACACTTGAGATTGTTTTCTAACT
TATGATATTTACACAAGGAACTGGCAGCTGTCTGATCCTGGTTT
```

SEQ ID NO: 57, OsFG-GAP homologue 1, deduced protein sequence
(NP_910026)
MRPLLAFAAVCALLVAAAAPAAAEEEKANKFRQREATDDMLGYPHLDEDALLKTKCPKHVEL
RWQTEVSSSIYATPLIADINSDGKLEVVVPSFVHYLEVLEGSDGDKLPGWPAFHQSNVHSSP
LLYDIDKDGTREIVLATYNGVVNFFRVSGYMMMDKLEVPRRKVHKDWYVGLNTDPVDRSHPD
VHDSSIAKKAASEESHPNIQDKPVVNESSKESQSRSTNDSTTRGVDSMKHASKEEPVESKPN
STRGQENMDVLNNLNSTDAGNNSSLSTTTENASHVQRRLLQTDEKSNQAGSSETDASDTGTA
KAATVENSEPLEADADASFNLFRDVEDLPDEYNYDYDDYVDETMWGDEDWKEQQHEKAEDYV
SIDAHILSTPVIADIDRDGIQEMVISVSYFFDHEYYDKPEHLKELGGIDIGKYIASSIVVFN LDTRQVKWTAELDLSTDSGNFTAHAYSSPTVVDLDGDGNLDILVGTSFGLFYVIDHRGKVRN
KFPLEMAEIHAPVIAADINDDGKIEMVTADVHGNVAAWTAEGEEIWEVHLKSLIPQRPTVGD
VNGDGRTEVVVPTVSGNIYVLSGKDGSKIQPFPYRTHGRIMSPVLLLDMSKHDEKSKGLTLA
TTSFDGYLYLIEGSSGCADVVDIGETSYSMVLADNVDGGDDLDLIVTTMNGNVFCFSTPSPH
HPLKEWRSSNQGRNNAAYRYNREGIYVKHGSRTFRDEEGKHFWVEFEIVDKYRVPYGNQAPY
NVTVTLLVPGNYQGERRIVVNAAYNEPGKQRMKLPTVPVRTTGTVLVEMVDKNGFYFSDEFS
LTFHMHYYKLLKWLVLLPMLGMFSVLVILRPQEGAPLPSFSRNID

SEQ ID NO: 58, OsFG-GAP homologue 2, coding sequence (AK068943)
GAGTGTCTAGGCCAGTCCAGTCCAGTCCAGGACGGTCCAGTCCGGTCCGTAGAGCG
CCGGCGCGTGTAGCTTCCTCCTCCGCTCCAGGCTCCAGCGAGGGAGGGAGGGAGACCACCGT
CTCCGCCGGCTTTGAGAGAGAAAGAGAAAGAGAGAGAGAGAGCGGCGAGATGCGGAAGCG
GGATCTGGGCATCCTCCTCCTCGCCGCCTTCGCCGTCTTCTTCTCGCTCCAGCACGACGGCG
ACCTCTCCTTCCGCGAGGCCTGGTACCACCTCTCCGATGCCGACTACCCCATCAAGCACGAC
GCCGACGCCCTCCCCTCTCCCCTAGTCGCCGACCTCAACGGCGACGGCAAACCCGAGGTCCT
CATCCCCACCCACGACGCCAAGATCCAGGTCCTCCAGCCCCACCCCAGGCCCTCCCCCGACG
ATGCCTCCTTCCACGACGCCCGCCTCATGGCTGATGTCTCCCTCCTCCCCTCCAACGTTCGC
CTCTCCTCCGGGAGGCGCCCCGTCGCCATGGCCGTTGGCACCGTCGACCGCCACTACGCCCA
CGCCCCCTCCCCCTCCAAGCAGCTCCTCGTCGTCGTCACCTCCGGATGGTCCGTCATGTGCT
TCGACCACAACCTCAAAAAGCTCTGGGAGGCTAATCTCCAGGACGATTTCCCCCACGCCGCC
CACCATCGCGAGGTTGCCATTTCCATTACCAACTACACTCTCAAGCATGGGGATGCAGGTTT
GGTCATCGTCGGAGGAAGGATGGAAATGCAACATCATTCAGCAGAGCTTTTCGATGAATTTA
TGGTGTCAGAACACAACAGGGAAGAGCACCGTAGAAGCGCCAGTGAGAAGCAGGCTTCTGAG
ACAGGCAACACAGACCTGCGTCATTTTGCCCTTTATGCTTTTGCTGGCCGCACTGGTGAATT
AAGATGGAGCCGAAAGAATGAGAATATCCCATCGCAACCATCCGATGCTTCAGTGCTGATAC
CACAACACAATTACAAGCTTGATGCCCATGCCCTTAATAGTCGTCATCCTGGTCAGTTCGAA
TGTCGGAATTTAGAGAATCAGTTCTTGGGGTCATGCCTCATCATTGGGATAGGAGAGAGGA
TACTTTTCTGCAACTTGCCCATTTTAGGAGGCATAAAAGGAAAGCACTGAAGAAAACACCTG
GAAAAGCTGTTGTAAATAACGTGCACAAGCCCAGTGAACATAATCCACCTGGAAAGGATGTT
TCCAATAGGTTAGCAAATGTGATTGGGAAAGCTGCAGATATGGCTAATTCAAATAAAATCAA
GAAGTCACAAAGGACGCTTTATGTTCCGACAATCACCAACTATACTCAAGTTTGGTGGGTTC
CTAATGTTGTTGTTGCCCACGAAAAAGAAGGGATAGAGGCTGTTCATCTAGCTTCTGGACGT
ACAATCTGCAAGCTTCATTTAACAGAAGGAGGCCTTCATGCAGATATTAATGGAGATGGGGT
TCTAGACCATGTTCAGGTTGTTGGTGCAAATGGCATCGAGCAAACAGTTGTTAGTGGTTCAA
TGGAAGTGCTGAAACCTTGTTGGGCAGTAGCTACATCTGGTGTGCCAGTGCGGGAGCAACTT
TTTAATGTTTCTATCTGCCATTACAACAATTTCAATTTGTTTCATCATGGTGACTTTTCAAG
AAGTTTTGGGAGGACATTTGATACAACTGGCTTAGAGGTGGCGACTCCTATTCTGCTCCAGA
GAGATGATGGTCATAAACACAGGAGAGGAAGCCACGGGGATATCATCTTTCTTACGAGTCGT
GGGGAGGTGACCTCGTACTCTCCAGGTCTACTTGGTCATGATGCAATATGGAGATGGCAACT
GTCAACAGGTGCAACATGGTCCAACCTTCCGTCTCCATCAGGGATGATGGAAAACATTGTAG
TTCCAACTTTGAAGGCTTTCTCTCTGCGAGCCTATGACCCAAAACAGGTAATCATCGCGGGT
GGTGATCTGGAGGCTGTGGTGATTTCTCCTTCTGGTGGTTTATTGGCATCCATTGAACTCCC
TGCACCTCCAACCCATGCGCTGGTACTTGAAGATTTCAATGGTGATGGTTTAACTGATATTA
TTCTGGTAACATCGGGGGGAGTCTATGGGTTTGTGCAGACAAGACATCCTGGGGCTCTTTTC
TTCAGCACGCTTGTGGGTTGCTTGATAGTTGTTATCGGAGTGATATTTGTTTCACTGCACCT
CAACTCCTCGAACAGCGGTAAACCTAGGGCTTCAACCGACTATAGGTGACGACATTATGTCA
GTCGACAGAATTCCTTGTCAATATTGAGGTGTTGTTATAGCATTTGATTTAGATTTTTCATA
TAATCAACTGCCAACTGGGTTATGTAAACTTGTGCGGCGAATGCATTTTTGGCGT

FIGURE 9 (continued)

SEQ ID NO: 59, OsFG-GAP homologue 2, deduced protein sequence (XP_463771)
MRKRDLGILLLAAFAVFFSLQHDGDLSFREAWYHLSDADYPIKHDADRLPSPLVADLNGDGK
PEVLIPTHDAKIQVLQPHPRPSPDDASFHDARLMADVSLLPSNVRLSSGRRPVAMAVGTVDR
HYAHAPSPSKQLLVVVTSGWSVMCFDHNLKKLWEANLQDDFPHAAHHREVAISITNYTLKHG
DAGLVIVGGRMEMQHHSAELFDEFMVSEHNREEHRRSASEKQASETGNTDLRHFALYAFAGR
TGELRWSRKNENIPSQPSDASVLIPQHNYKLDAHALNSRHPGQFECREFRESVLGVMPHHWD
RREDTFLQLAHFRRHKRKALKKTPGKAVVNNVHKPSEHNPPGKDVSNRLANVIGKAADMANS
NKIKKSQRTLYVPTITNYTQVWWVPNVVVAHEKEGIEAVHLASGRTICKLHLTEGGLHADIN
GDGVLDHVQVVGANGIEQTVVSGSMEVLKPCWAVATSGVPVREQLFNVSICHYNNFNLFHHG
DFSRSFGRTFDTTGLEVATPILLQRDDGHKHRRGSHGDIIFLTSRGEVTSYSPGLLGHDAIW
RWQLSTGATWSNLPSPSGMMENIVVPTLKAFSLRAYDPKQVIIAGGDLEAVVISPSGGLLAS
IELPAPPTHALVLEDFNGDGLTDIILVTSGGVYGFVQTRHPGALFFSTLVGCLIVVIGVIFV
SLHLNSSNSGKPRASTDYR SEQ ID NO: 60, *Triticum aestivum* FG-GAP homologue, partial sequence (CK207217)
GCGTTCCGGAGCTTTNAAAAGAGTCAGGAGGGATTGACATAGGACCATATATTGCATGCAGT
ATAGTTGTGGGTAACCTTGACACAAAACAAGTTAAATGGACAGCAGAACTCGATTTGAGTAC
CGAAAGCGGGAAATTCCTTGCCCATGCATATTCGTCTCCAACTGTGGTTGATTTGGATGGTG
ATGGAAATTTGGATATCCTTGTCGGAACTTCCTATGGCTTGTTTTATGTTCTTGATCATCAC
GGTAAGACTAGGAAAAATTTCCCCCTTGAGATGGCTGAGATCCATGCACCAGTCATTGCAGC
AGACATCAATGATGATGGTAAGATCGAGATGGTCACTGCTGATGTGCATGGTAATGTAGCAG
CTTGGACTGCAGAGGGAGACGAAATCTGGGAGGTGCATCTGAAGAGCCTTGTTCCACAGCGA
CCTACTGTCGGGGACGTCAATGGAGATGGCCACACTGATGTTGTGGTCCCAACTGTATCAGG
AAACATCTACGTTCTTAGTGGAAAGGATGGCTCAAAAGTTCAGCCTTTCCCATATAGAACAC
ATGGAAGGATCATGAGTCCGGTCTTGTTAGTTGACATGAGCAAACGTGGAGAAAAGACGCAA
GGACTAACCCTTGCTACTACGTCCTTTGATGGTTATTTGTATTTGATCGAGGGCTCTAGTGG
CTGTGCAGATGTTGTCGACATTGGAGAGACCTCGTACACTATGGGTTTGGCTGACAATGTGG
ATGGCGGAGATGACCTTGATCTGATTGTTACTACCATGATTGGCAATGTCTTTTGCTTTTTC
ACTCCCTCACCGGAACATCCTCTCAAGGAATGGAGATCATCAAACCAGGAAAGGAATAATGC
TGCATATAGGCACCACCCGTCAAGGTATTTATGTAAGGCATGGTTCAGGACAACCCGGGAAT
GAAAAGGGTAAACATTTCGGGGTCGATTTGAAAATTGGAGACAAGTACAGGGTTCCCTATGG
GAATTAACTCCTTAAAATGTCAGGGTACCTTACTCGTCCTGGGAATTACCAGGGAAACAGGG
GTATTGGGGTTTGCCAATTTTAAAATGAACCGGGCACAAGGAATTGGGT SEQ ID NO: 61, *Zea mays* FG-GAP homologue, partial sequence (AY111316)
ACAGGCTTATTATAGGTTTGTTTTCTACTAATAGTTATGAAGAGCGTTTTGACACAGTATCC
GAGAGTTTTGCTTCTCCTCTCCGAGGGTCGCTTCTCTTAGAATCTGACAATTACCGTTTCAA
AGGCCTACTGTAAACTCTCAATGGTGACAATATGCTTGTTCTTTGGGTGAGCCAATATTGAA
AATGGCTGTGTACAAAATTGTTCTGCAGAACTAAATGGGTACATTNNNNNNNNNNNNNNNNN
NNNNNNNNAAATGGTTAACTGTTGGGATACTACACTGAACAAGACATTTAGGTCATGGAGAT
GTTGGGGAGTCACTTCGTCAGCTTCAATGGGTCACCGGCATTTCACCACTAGTCGATATTCC
GTGAAAACGATGGCAGCGGCGCACCTTCTTGGGGCCTCAAGATNNNNNNNNNNNNNNNNNNN
NNNNNNNNNNNNNNNNNNNNNNNNNNNNNNNNNNNNNNNNNNAGTAATGCATGTGGAAGGTGAG
TGAGAACTCGTCGGAGAAGTACAGCCCANNNNNATCGATCATCTCCACGACCACAGTTCCAG
TAGTTCTAACAGGAACAGTGGGAAGCATCATCCGTTGCTTCCCTGGTTGATGATACACACCA

FIGURE 9 (continued)

CTGACAACAATGCGCCTATCTCCTTGATAATTCCCCGGAACAAGTAAAGTTACCGTCACGTT
ATAAGGAGCTTGCTTCCCATAGGGCACCCTGTACTTGTCAACGATTTCAAACTCTATCCAGA
AATTCTTGCCCTCTTCGTCACGGAAGGTCCTGGAACCATGCTTAACATAGATACCTTCACGG
TTGTACTGATATGCAGCATTATTCCTTCCTTGGTTTGATGACCTCCATTCCTTAAGCGGATG
GTGTGGTGATTGAGTGGAGAAGCAGAAGACGTTGCCATTCATAGTGGTAACAATAAGATCAA
GGTCATCTCCACCATCCACGTTATCAGCCAAAACCATAGTGTACGAGGTCTCTCCAATGTCA
ACAACATCTGCACAGCCACTCGATCCCTCAATNNNNNNNNNNNNNNNNNNNNNNNNACGTTGT
TGCAAGAGTTAGCCCTTTTGCATTGTCTCCATGTTTGCTCATGTCGAGAAGTAGAACAGGAC
TCATGATTCTTCCATGTGTTCTATATGGGAAAGGTT

SEQ ID NO: 62, Solanum tuberosum FG-GAP homologue, partial sequence (BG598275)
GTTTCAATCTAGATACCAAGCAAGTTAAATGGACTGCACAGTTGGACTTAAGTACTGACGAC
GGGAAATTCCGTGCCTATATATACTCTTCTCCTACGGTAGTTGATTTGGATGGTGATGGAAA
CATGGACATTCTAGTGGGGACCTCCTATGGCTTCTTTTATGTGTTGGATCACAACGGCAAAG
TGAGGGAAAAGTTCCCTCTCGAAATGGCTGAAATCCAAGGAGCAGTAGTTGCAGCTGATATC
AATGATGATGGAAAGATTGAACTAGTTACAACAGATTCACATGGAAATGTTGCTGCTTGGAC
CGCACAAGGCACAGAAATTTGGGAAACGCATCTCAAGAGCCTTGTTCCTCAGGGACCGGTTA
TTGGCGATGTGGATGGAGATGGCCATACAGATGTCGTTGTCCCAACACTTTCTGGGAATATA
TATGTTCTGAATGGCAAGGACGGCTCATTTGTACGTCCATATCCTTATAGGACTCATGGTAG
GGTGATGAATCGAGCACTTCTTGTCGACTTGAGCAAACGTGGGGAGAAGAAAAAAGGGCTTA
CAATTGTCACAATGTCATTTGATGGTTATTTGTATCTCATAGATGGACCAACATCATGTGCT
GATGTTGTAGATATTGGTGAAACTTCATACAGCATGGTCTTGGCTGATAATGTTGATGGTGG
CGATGATCTTGATCTTATTGTAACAACCATGAATGGTA

SEQ ID NO: 63, Aquilegia sp. FG-GAP homologue, partial sequence (DT735817)
GTGAATATTGATTCACACATCCTTTGCACTCCTGTGATTGCAGACATCGACAATGACGGAGT
ATCAGAAATGGTTGTCGCTGTATCCTATTTCTTTGATCATGAGTATTATGACAACCCAGAGC
ATCTCTCTGAGTTGGGTGGCATAGATATTGGGAAATATGTAGCGGGAGGAATTGTAGTATTT
GATCTTGATACAAGACAAGTTAAGTGGACAACAGAGCTAGATCTTAGTACAGACACAGGGGA
CTTCCGTGCTTATATATATTCTTCTCCAACGGTGGTCGATTTGGATGGAGATGGAAATTTGG
ACATTCTTGTTGGGACATCTTTTGGCTTGTTTTATGTTTTGGACCATAATGGCAAGATAAGA
AACAAGTTCCCTCTCGAAATGGCTGAGATTCAGGGCTCTGTCATTGCGGCGGATATAAATGA
TGATGGAAAAATTGAATTGGTTACAACTGATACTCATGGAAATGTTGCTGCATGGACCCCAG
AAGGAGAAGAAATTTGGGAAGTACATCTTAAGAGTCTTGTTCCACAACGTCCAACAGTTGGT
GATGTTGATGGCGATGGTCATACTGATGTGGTGGTTCCTACACTATCAGGGAACATATACGT
TCTCAGTGGCAAGGATGGCTCTTTTGTTCACCCATACCCATATCGTACTCATGGGAGAGTCA
TGAATCAAGTTCTTTTAGTAGATCTAAGTAAACGTGAAGAGAAACAGAAGGGACTCACTCTT
GTCACAACATCATTTGATGGCTATTTGTACCTTATTGACGGACCATCATCTTGTGCTGATGT
TGTTGATATTGGCGAGACTTCATATAGTATGGTCTTGGCAGACAATGTTGATGGTGGGGATG
ATCTTGATCTAATTGTTACAACTATGAATGGGAATG

FIGURE 9 (continued)

**SEQ ID NO: 64, *Brassica napus* FG-GAP homologue, partial sequence (CX192752)**
ATTTGGGAAGTGCATCTAAAGAGTCTTGTTCCCCAGGGTCCTTCAATAGGCGATGTTGATGG
TGATGGACATACTGATGTCGTGGTTCCTACAACGTCAGGAAACATTTATGTTCTTAGTGGCA
AGGATGGTTCGATTATACGTCCGTACCCGTACAGAACTCATGGAAGAGTGATGAACCAACTT
CTTCTTGTTGATCTGAACAAGCGAGGTGAGAAAAAGAAGGGGCTCACCATTGTTACCACATC
CTTTGACGGTTACATGTACCTCATAGATGGACCCACCTCATGCACGGACGCTGTTGATATTG
GTGAAACTTCATACAGCATGGTCTTGGCTGATAATGTTGACGGTGGAGATGATCTTGATCTA
ATCGTCTCAACTATGAATGGAAACGTCTTTTGCTTCTCTACACCTTCTCCTCACCATCCCCT
CAAGGCGTGGAGATCGACTGATCAAGGGAGGAACAATAAGGCAATCCGTTACGGTCGTGAAG
GTGTCTTTGTCACTCATTCAACCAGAGGCTTCCGTGACGAGGAAGGCAAAAACTTCTGGGCT
GAGATCGAGATTGTTGATAACTACAGATACCCATCTGGTTCACAAGCACCCTACAACGTTAC
TACGACGTTGTTGGTACCAGGCAACTACCAAGGAGATAGGAGGATAACACATAGCCAGATCT
ATGACCGACCAGGAAAATACAGAATT

**SEQ ID NO: 65, *Citrus sinensis* FG-GAP homologue, partial sequence (CX674859)**
GTTGATGGGGATGGCCATACTGATGTTGTAGTTCCAACACTATCGGGGAACATTTACGTTCT
TAGTGGCAAGGATGGCAGTAAAGTCCGTCCTTATCCTTATAGAACTCATGGAAGGGTGATGA
ATCAAGTCCTTCTTGTTGATTTAACTAAACGCGGGGAGAAAAGCAAGGGACTCACAATTGTT
ACAACATCTTTTGATGGCTATTTGTACCTTATAGATGGCCCAACATCATGTGCTGATGTAGT
CGACATTGGCGAAACTTCATATAGCATGGTCTTAGCTGACAATGTTGACGGTGGAGATGATC
TTGATCTTATTGTTACCACAATGAACGGCAATGTTTTTGCTTCTCAACTCCTGCTCCACAC
CATCCCCTCAAGGCATGGAGATCAATTAACCAAGGAAGAAACAATGTTGCAATCCGTTACAA
CCGTGAAGGAATCTATGTTACACATCCATCAAGAGCTTTCCGTGATGAGGAAGGCAGAAACT
TCTGGGTGGAGATTGAGATTGTAGATGAATATAGATTCCCATCTGGGTCCCAAGCTCCATAT
AATGTCACTACAACATTGTTGGTCCCCGGCAATTACCAAGGTGAGAGGAGGATTAAGCAAAG
CCAAATCTTTGCACGTCGTGGAAAATATAGAATCAAATTGCCGACAGTCGGGGTAAGGACGA
CAGGGACTGTTTTGGTGGAGATGGTTGACAAGAACGGACTTTATTTCTCAGACGAATTCTCG
CTTACATTCCATATGTATTACTATAAACTACTAAAGTGGCTCCTAGTCCTCCCGATGCTCGG
GATGTTTGGTGTGCTTGTCATCCTTCGT

**SEQ ID NO: 66, *Asparagus officinalis* FG-GAP homologue, partial sequence (CV288972)**
GGGTGGAAAGGATGGATCGTTTGTTCGACCCTTCCCCTATAGGACACGAGGGAGATTGATGA
GTCCAGTTCTTCTGGCTGATTTAAGCAAACGTGATGAAAAGTTAAAGGGCCTAACTCTTGTT
ACAACTGCATTTGATGGCTATTTGTACCTAATTGATGGGTCCACTGGTTGTACGGATGTTGT
TGACATTGGCGAGACATCATACACCATGGTCTTGGCAGATAATGTTGATGGTGGGGACGATC
TTGACCTTATTGTTACTACTATGAATGGCAATGTCTTTTGCTTTTCCACACCCTCACCGCAT
CATCCTCTGAAGGAATGGAGATCATCCAACCAGGGAAGAAACAATGCAGCAAGTAGATATAA
CCGTGAAGGAATATACATATCACATGGATCCAGAGCTTTCCGCGATGAGGAAGGTAAACATT
TCTGGGTGGAGCTGGAGATAATAGACAAGTACAGGTTTCCCTCAGGGCATCAAGGGCCTTAT
AATGTCACAACAACATTATTAGTTCCTGGAAATTACCAAGGAGAAAGGCGAATTGTCGTCAA
CAATGTATATAATCAACCTGGAAAGCAACGGATAAAGCTGCCAACAGTTCCTGTTCGAACAA
CAGGGACTGTGCTGGTGGAGATGGTTGACAAGAATGGATTGTATTTCTCTGATGAATTTTCT
CTTACATTTCACATGCATTACTACAAGCTACTGAAGTGGCTTCTGTTTCTACCGATGCTCGG
AATGTTTGGAGTTCTTGTCATTCTACGTCCCCAGGAAGGTGCACCGTTACCATCGTTTTCAC
GAAATTTGGATTGATATTAATGATATCATCCAATGAAGATGAGAATACTCCAAAGTGCGATG
CTATCTGACATGTATGCCTTTGTACATCTGAATGTGTG

**SEQ ID NO: 67, *Populus* sp. FG-GAP homologue 1, partial sequence (CN520999)**
TGAATCAAGTTCTTCTTCTTGACTTAAGTAAACNNNNNNGAGAAAAACAAGGGACTCACACT
TGTTACAACATCATTCGATGGTTATCTTTACCTTATAGATGGACCAACTTCTTGTGCTGATG
TTGTTGATATTGGTGAAACTTCATATAGCATGGTCTTGGCAGACAATGTTGATGGTGGAGAT
GATCTTGATCTCATAGTTTCAACAATGAATGGAAATGTCTTTTGCTTTTCAACTCCTGTTCC
ACATCATCCCCTGAAGGCTTGGAGATCTAATAATCAAGGAAGAAACAATGTAGCAAACCGCT
ACAACCGTGAAGGGGTGTATATTAAACCTTCATCAAGAAGTTTCCGTGATGAGGAGGGGAAG
AGCTTCTGGGTGGAATTTGAGATTGTGGACAAGTATAGAATCCCGTCTGGGTCTCAAGCACC
TTATAATGTCACTACAACCCTGTTAGTTCCTGGCAATTATCAAGGTGAACGACGGATAAAGC
AAAATCAAATCTTTGACCGTCCAGGAAAATATCGGATAAAACTTCCAACAGTTGGAGTGAGA
ACTACTGGAACTGTTTTGGTGGAGATGGTTGATAAGAATGGACTCTATTTCTCAGATGACTT
CTCGCTTACATTCCACATGCATTACTATAAACTGCTGAAGTGNCTCCTTGTCCTCCCAATGC
TTGNNNTGTTTGGTGTGCTTGTCATCCTTCGTCCACAAGAGGCCGTGCCCTTGCCANNNNNNN
TNNNGGAATACTGACNNGTGANNNNCATNNNNNAC

**SEQ ID NO: 68, *Populus* sp. FG-GAP homologue 2, partial sequence (CX176799)**
GGCACGAGCACACTTGTTACAACATCATTTGATGGTTATTTGTACCTTATAGACGGACCAAC
TTCTTGTGCTGATGTTGTTGATATTGGTGAAACTTCATACAGCATGGTCTTGGCAGATAATG
TTGATGGTGGAGATGATCTAGATCTCATAGTCTCAACAATGAATGGGAATGTCTTTTGCTTT
TCAACTCCTGTTCCACATCACCCTCTCAAGGCTTGGAGATCTTCTAATCAAGGAAGAAACAA
CGTGGTGAACCGCTACAACCGTGAAGGGGTTTATGTTACACCTTCATCAAGAAGTTTTCGTG
ATGAGGAGGGAAAGAGCTTCTGGGTGGAATTTGAGATTGTAGACAAGTATAGATTCCCATCT
GGGTCTCAAGCACCTTATAATGTCACTACAACCCTTTTAGTTCCTGGCAATTATCAAGGTGA
GAGACGAATAAAGCAAAGCCAAATCTTTGACCGTCCAGGAAATTATCGGGTAAAACTTCCAA
CAGTTGGAGTGAGGACTACTGGAACTGTTTTGGTGGAGATGGTTGATAAGAACGGGCTCTAT
TTCTCAGATGACTTCTCCCTTACGTTTCACATGCATTACTATAAACTGCTGAAGTGGCTCCT
AGTCCTCCCAATGCTTGGAATGTTTTGTGTGCTTGTCATCCTTCGTCCACAGAGGCCATGCC
CCTTACATCATTTTCAGGAATACTGACTTGTGATATCATCT

**SEQ ID NO: 69, *Euphorbia esula* FG-GAP homologue, partial sequence (DV130386)**
CTGATACCCNNTGAAATGTTGCTGCTTGGACTTCACAAGGAAAGGAAATTTGGGAGAGGCAT
CTCAAAAGTCTTATTTCCCAGGGCCCATCAGTTGGTGATGTGGATGGGGATGGCCATACCGA
TGTGGTAGTCCCTACTATATCTGGGAATATATATGTTTTGAGCGGCAAGGATGGGTCAAATG
TTCGCCCATACCCATATAGAACCCATGGGAGAGTAATGAATCAAGTTCTCCTTGTTGATTTA
AGTAAACGTGGGGAGAAAAGCACCGGACTCAGCCTTGTAACAACTTCATTTGATGGATACTT
GTACCTTATAGATGGGCCCACATCCTGCGCTGATGTCGTTGATATTGGTGAAACCTCATATA
GCATGGTCTTAGCGGACAATGTAGACGGAGGAGATGACCTTGACCTAGTAGTCACAACAATG
AATGGGAACGTCTTTTGCTTCGCGACTCCTGTTCCACATCATCCCCTTAAGGCATGGAGATC
GGCTAATCAAGGTAGAAATAATGTGGCAAACAGATTTAACCGTGAAGGGGTCTATGTTACAC
CTTCATCAAGAGCTTTTCGAGACGAGGAAGGAAAGAATTTCTGGGTGGAAATCGAAATCGTG
GATAAATATAGATACCCTTCTGGTTCTCAAGCACCTTATAAAGTCACTACAACCCTGTTAGT
TCCGGGTAATTATCAAGGTGAG

FIGURE 9 (continued)

SEQ ID NO: 70, *Ceratopteris richardii* FG-GAP homologue, partial sequence, (CV736049)
CCACGCGTCCGGGTTACAACAGATGCCCGGGGAAATGTTGCTGCATGGACAAATAAAGGAAA
AGAAATTTGGGAAGTTCACTTAAAAAGCTTGATTGCTCAGGGTCCGACTGTCGGAGATATTG
ATGGAGACGGAACATTGGATATTGTTGTGCCAACTGTGTCAGGAAATATATATGTTTTGCAT
GGAAAGACTGGTGTTACTATGAAGCCATATCCATTTCGTACCCATGGGCGTGTGATGGCTCC
TGTTCTTCTGGTGGACTTGGCCAAGCTAGGCACCGAGAGAAGAGGTCTGGTCCTGGTGGTTT
CATCATTTGATGGGTACCTCTACCTCATAGATGGTCCCACAGCCTGTGCTGATGTGGTTGAT
GTAGGAGAGACATCCTACACAATGGTGCTTGCAGACAACGTTGATGGAGGAGATGATTTGGA
TTTAATAGTGACGACCATGAATGGGAATGTTTTCTGCTTCTCTACACCTGCTCCTTATCATC
CTTTACGGTCATGGACCTCACAGAATCAGGGTAGGAGCAATCTTGCATCTCGTATAAGACAT
GAAGGGATTTATGCTACATCTGGCTCGAGAAGTTTCAGGGATGAAGGTGGTGAAAGTTTTTG
GGTGCATTTCAATATTATTGATGAGAACCGCTTACCTTCGGGGCCTTACAATATTACGGCTA
CCCTTCTTGTCCCCCACAACTACATGGGTCCAAGGCGCATTACAGAGAGTCAGTTAATTCAA
CAACCAGGAACGCACAAGTTCAAACTGCCATGTGTATCTGTACGATCATCTGGGACTGTAGT
TCTAGAGATGGTGGATAAACATGGGTTCTATTTCACTGATGAGTATTCATTGACATTCCACA
TGCACTATTATCGGCTACTGAAATGGATGGTAGTGCTTCCAATGCTTGGAATGCTTTTTGTC
TTGTTGTGGCTTCATCCTGAGGATGCCATATCAGTTCTTCCTTCCTTTTCAAGGGATCATTA
AAATGACATATGAGCTCAATTTTTGGTACTCCTAAATCCAAACCTTATTGTAAATGTATACA
TTTTGACATTTATCCAGTCTACTAAAGAAATGCA SEQ ID NO: 71, *Welwitschia mirabilis* FG-GAP homologue, partial sequence, (DT601669)
ATGACAATCATGAACACTTGAAGGAGCTGGGTGATATTGATATTAGCAAATATGTTTCAGGT
GCTATAGTGGTATTTAATCTTGATACAAAGCAAGTGAAGTGGAGTACTCAGTTGGATCTTAG
CACAACCTCTGGGACTTTTAATGCATACATCTATTCTTCTCCTACTGTGGTTGACCTGGATG
GTGACGGCAATTTGGATATTATTGTTGGCACGTCATTTGGTTTCTTTTATGTATTGGATCAC
CATGGAAAAAATAGAGAAGGCTTTCCATTACAGATGGGTGAGATTCAAGGACAAGTAATTGC
TGCTGATATAAATGATGATGGGAAGATTGAAATGGTTACAACAGATACCCGTGGAAATGTGG
CTGCTTGGACTTCTCAGGGGAAAGAAATATGGGAGATACATTTAAAAAGTCTTATTGCTCAG
GGGCCTACAGTAGGTGATATTGATGGAGATGGTCATACAGATTTGGTGGTTCCTACAGTATC
AGGAAATATTTATGTATTAAATGGGAAAGATGGATCATTGGTGAAGCCATTTCCTTATCGTA
CTCATGGAAGAGTCATGAGTCCGGTACTTTTGGTTGACCTTAGCAAACGTGGGGAAAAGCAA
AAGGGCTTAACTCTTGCAGCATTATCATTTGATGGTTACTTCTACTTAATTGATGGTCAAAC
AGCTTGTGCAGATGTTGTTGATATTGGAGAGACTTCCTACTCTATGGCTTTGGCGGACAATG
TAGATGGCGGCGATGATCTTGATTTTATTATCACAACTATGAATGGCAATGTGTTCTGCTTT
TCAACCCCTGCTCCACATCATCCA SEQ ID NO: 72, *Medicago sativa*, genomic sequence encoding FG-GAP homologue
ATGAGGAAGCGTGATTTGGCGATTCTTATGCTCTGCGCTTTCGCTATTTTCTTCTCTCTTCA
GGTATTGTACCCTTTAACCCCCTAATTCACTTTCTCACTCTTAAACCCTAACCCTCATTTTC
AATTCAATTGATTCAGCAAGATGGTGGTGTTTCATTCAAAGACGCGTGGATGCATCTAACAG
ATGAATACCCAATCAAATACGAAGCCGAACGCTTCCTCCTCCTGTTGTCGCCGATCTCAAC
GGCGATGGTAAGAAGAAGTTCTCGTAGCTACCCACGATGCCAAAATTCAGGTTCTTTCATT
TCCCAATTTTCCTCAATTTTTTATTCACTTATAAAATTCCAGGTTTTATTTGGTTTCCTTCA
CAACTGGACATTGTCAAAAAACATTTTTTTTCTTTCAGTAAACCATCAATGTAGTTGATGA

```
ACTATAACTCTCTTCAATTTAGTTTGTAAGTAGTCTCTAAAATTCATCAATTAATCCCTGCT
ATTAATGTTTGGTTCTACACCGAAGAAAGTTGACTTTGAATGAGTTGATTGTGTAAACTCTA
TTTGGGCTAAAATTGATTTGAAGGTAAAGTGATTTATGTTTGGACTTTGGATACATTCATGT
AAAAGTGAATTGAACAGGTGAAAAATCAACTCTAGAATCAGAAGCTACAATTTCTAACTTTA
AGTAGAATGTAGAATCAATTCTGGAGGTAAAATCAATTTTACTCTAGAAGAACCAAATATGT
CAATCAATTTTGGGTCCTCCAAAATTAGAACCAAACATACAGAAAGTAGAGACTAAAATTGA
TGGATTTTCATATACTTTAGGGACTTAATTGACCGGTTTTATATACTTTAAAGACTACTTAT
CATATTTATATAGTTTAGGGACTAGATTGATGGTACAAGTAATATAGTAGTAACTGGATTTT
GTATTTATGGTCGGTGTCTTAGATTTTGGAGCCACATAGTAGGCGTGTTGATGAAGGATTCA
GTGAGGCACGTGTGTTAGCGGAGGTGTCTCTGTTGCCTGACAAAGTGCGTGTCATGTCTGGG
AGACGACCTGTTGCTATGGCCACTGGCTTTATTGACCGCCATAGAATTGGACAACCACATAA
GCAGGTTTTGGTTGTAGTAACATCGGGTTGGTTTGTAATGTGTTTTGATTCCAACCTCCAAA
AGTTGTGGGAAAATAATTTGCAGGTATGATGTTTATGTTGTGCCATGTTTCAGTTGATAGAA
TTTTCAGTTAAACATTTTGATTATCTTGTTATGTTTTAGTTTACCAACTGTTTTAGTGGTTG
TTAACAGGAGGATTTCCCCCATAATGCTCACCACAGGGAAGTTTCAATATCTATAAGCAATT
ATACTCTCAAGCATGGAGATACAGGATTGATCATTGTTGGTGGGAGAATGGAAATGCAGCCT
CATGTATGTGTCACTTTCCTTCTTGTTTTCTGGTTTGTTATTCTTTTTAGCAGAGTATGTGT
GTCTGTGTTCTATCTGCTGATGGAAAAACTTAGAATTTAATGTGGATGGTGTTTACCATCTT
TTATGAAAGCGAAAACTCTCAACTTCATGAGTAGCATAAGATTCTGGCTATCTTGTTTTCTT
GGAAGTGATGAAAATGAAAGTTCCTGAGTAATTTTATTTGATAAAGTATGATGGTAATGTGA
GGGTTTGCTGCTGCTTCTCGAGTTTCAGAATTTTTTATTTGTTATTTGATTCTTTCTATGGT
AATGATTTTGGAATTGTTCATCTTTGGAATTATTGGCATTATCTTCTAATCTGATGGTTCTG
TTGGCTTATGTTGATTGCTTTCCATTTTCAGATTTTTATGGACCCTTTTGAAGAAATGGGAA
TGGGAGCTAGATTTGCTGAGCAGCATCGAAGAAGTGCTACTGAAAAGGAGGTATAGATACGT
TTCTAGTTGATGCTAAATTTTATGCCCATTTTTTTACTATCTGTAGCATGCTAATTTTGGTT
TAAACTTTGAGACACTATTTGCTTTATTTATTTCACTTTAATTTTGGGTCTTCAAGGTTGAC
CTTATTTTATGCTCCTAAACAGTCAATTCAAATTCCTATTTTGATATAAATAGATAATATAA
AAGTTCACCATGTCTTGGCATGATAAAGCCAATAAATAAAATCTGTGCACCTTGCAGTAAGT
AGTCTATAAATCTGAACCTTCATGATCAGGTAGCTAAATAAACAGGAGACAGTTTCACTCGT
TTTGTTTAGATTTTTGTTTTTACAAAAAAATGTATCAGGTGATTTAGTTTTCTTCCCATTT
TAAGGTTGAAGACTTTAACTTGTTTATTGTGTTCCTTTTTCTGGATAGGCTTCTGAAAACAC
CGGAACTGTGGATTTACGCCATTTTGCATTTATGCATTTGCTGGTCGATCAGGTGTAGAAC
GATGGAGCAGAAAAACAGAGGTGGTGTTCTTTTTTTTTTGTTTTCAGTGCGCTCTATTATTT
GGGTGTTGTCAACATGCAAATATGAAACAATTATTTATTTTTAATTTAAAAATGCATTTTCT
TGTTTTTTAAAAGAGCTGTCTTTTCTATCTGGAAATTCATTAGGTGATTAAGTGAACTTTCT
CTGTCCTCCCTCTCTGTACATAACTTTATTCAGGGGTAGCAACTTAGTTCTAGACAGTATG
TTTTGTCCTGCAACAGACATGAAAACTGAAGAAAAGTTATATAGTTAAGCTCACAAAGTTCA
GAACATAATGAGTTAGAGCCTAAATGTCAATAATAGATTATAAATTATACCTTTGAAGATAT
TGGAGTCTTGTTGCAAGCATCTGCACTTGGATTTTAACGCACTGGTGCACAAATATGTATTT
TTTGAAAAGAAAATCTATCAAACAAATGGAACCACCTCCCAACCAGCATAAACTTTAGTCTT
TTCTGTCTTTGGGTGGTAGTACCAGATAGATGTTTTACAATCAACATAGCGGTCCAGTTTGA
TTGAATATGTGATTTACGCTAGTCCAACATTTATTTGTTAAATGATCTTGTGTATCCTTGT
CCTTTTTTTTTCTTTTCTTTTCTAATTGCTAGTATTGTGATTTAATTGTTTAGAACATTGA
AGCAGCAGCTTCTTCAGACGCATCACAGTTAATTCCACAGCATAACTACAAACTTGATGTTC
ATGCTCTGAATAGACGTCAACCTGGAGAGGTACTTAGCTATAGCTGTTCAATTTAATCCTAA
ATTCCTAATGGTATATTGAATTGATGGAATATGGTAAATTGGAGTGGCATAAAATACCATTC
CATCCTTTTTAAGCAGGGGAATCATTGCTTTTCTTTTTCATACATCCATTTTATTCTAATCT
```

FIGURE 9 (continued)

```
AGAAATATGCATGTTGATTTTTATGTTCTCCCCTTTAGCTCAACGTACTGATTTTGTTATAT
GTAAGTAATACTGTAATTTCAGATTTATTACTTTTTCCATTCCTTTCCTCATCAATCTTAAG
TAATACCGTAGAATAGATTCCTAGTCATATCTTTATGTTCTTCACCTTTTCTCTTCAAATGA
TCAAACACTAAAGCAAATATTTGTTTGTTAATATGGAGTTTACTATGAGAACTCTAGTACAA
TAGTACTCATCCAAATCTACTTGAGTAACTTGGTCATCTCCTTCCTTTGTGTGTGGAAATAG
CAGCATGTGCACATAAAGGAGTGTTTCAATCAAATTTAATATTATTGTGAAACCTTTGTATA
TGTTTATCCATATCTACCCAATAGATAGCTTCCTGTGACATGTGAAATTATAGTTTGAATGC
AGGGAATTCAGAGAATCAATCCTGGGAGTTATGCCACATCAATGGGTACACTCTATTTTCAA
CCTTGATTAACGTTTGGTACTAAAGCATAATCTCAAATGTCATAGTTAACTGATATTAGATA
CATGCACTCATCAGGATAGGAGAGAAGATACTTTATTGAAGTTGGTCCACTTCAATCGGCAT
AAGAGGAAAACATTGAAGAAAACACCTGGAAAGACTATCAATTACCCTTTCGACAAGCCTGA
GGAAAACCATCCACCAGGGAAGGACTCAACCAAAAAATTTCAAACATAATTGGGAAAGCAG
CAAATTTTGCTGGTTCAGCAAAATCCAAGAAGGTAATTAGAAACCATGTCATGCAATGCAAC
TGGTAACAATTCATTCAATTGTTGACATAATGATAATTAGTTTTAAGATGGCTACAACTGGA
CAACTCAAAAATTCTTTTCCAAACATGATTTCAGCTACAAGCTTTTGTTGTCTTTATCCAGT
AACAGAGCTGTCTGTTTACTTTCTAACTACTGCATGTCCAATTTTTGTTATGTGATCTAAA
TCTTTGTGTTGGTAATATTCTCAGCATCTGCTGATTTTAATTCATTTTGGCTAAACCTATTT
TGAATTTGTTATGATAACCATTGCTTAGCATTTTTAATTTTTTTTTAAACTAAGCACTGGT
CAGATAAACCATCTCACTTGTTATATTTGTATTTGTTCTTAAAGATTTAAGTCTAGCTACAT
TTTTTATTTCTCATTTAAATTTTTTGAATCCTGAATTTAGGGAGCCAAGATATTTAGTTATA
AAAATAATGATTAATAATAAATATGCAGTTCTCCCCATTGTCGTGTTAATTTGGTAGATAGC
ATAGTAGTCAATCTTGGATAGCGGTGCGTAGTGGCCAACCCCAAAAATGGGATAGCGTATAG
CGGTATGACAAATAGCGGTCACCGATGTTTGATTATTTTTGGACAATTATATGAATAATAG
CAAAGTATAAACAAACTTATATATTTCTCAACAAAAAAAACTTATATTAAATATAACACTCA
AATCTCACGAGACATTCATAAATCAAAACACCGAAAACAAAAGACAGGAACAAATAAAAAAA
ATCATAAAACAGGAGAAACCATAAGATAGAAGATAGAAGAGTGTGTTTCGCGGCACAGGTGA
GAAGAGAGAAAAAGTTGAAAAATGTTAGGGTTTACGAAATCCTCAAAATGCCCTAAAAAAGG
TTTTAAAAATAGGGTCAATTTGGAAATTTCCTACTAAAATAAATAGCGGCTGCTATCCAACC
CGCACCGCTATAGCAGCTGAAGCGGCCGCTATTTGATTCCGCGCTATTTGATACCGCTATGC
TACACGCGGCCGCTATAGCGCCACTATCGGCTGCTATTGACTACTATGGTAGATAGAAACTG
TTAGGTTACCTAGTAGGGCTGATGATGTGTTAGTGGGCTCAAGTAATGAGTGAGAGGCCCAT
TATTTGGAGGGTGTATGAACGTGGGAAGAAGAGAGGAGAGAAGGGACTAAGGGTGCTTCCTA
GCTGGCAGTTAGTTAGTATGAGGCAGAGGGAGTGAATATATTTCTTCTGAGGAGCTGTTGCT
CTAGTTTATCCGTCATAGTGATTTCATTGTTATTCTAGTTTAGCCAGGCTTTGGGAGTATTT
GGTATATCTACCTCGAAGATGCTAGGTCCTAAAATGATGCAGTTGGAAGGTTCGATTGCGGG
AGTCTCTCTGTTGGTGATGATTTAAACACAATTTCATATACTCCTGGTGTGGTTGAAGCGTT
GGGGGTTGCCTTTGGATTCATCAGATACTGCTGGTGTGCATTTGGGTGGGGGTGGGGGTCA
TATGGTGCAGATATTGGGCAAATGTGTGGTTGGCTTCTGCATATCGGCCCTTATGCAGTCTT
GCTGGATACATATGTGTTGGGGTTAGAAGAGGTCATGCCAAAGTACCAATTACTCTCTTAAT
ACCTGTCTAATAAGACTCTAATGCTTTAAATTGACGAGGATTTGCATTTTTCACCTTTCACT
GGCAAACATATGGGTTAAACTGGTAGATGTTTAGCGTGTTCAAGTACAAGCTGTGTTCCCAT
AGATGAAGTACTTCATGTTTGGGGAGTTTGATCGTTAAACTACCTAATTGTTTGTTTAAATG
AATTTTGAATTCCCTCTTCTAATAATTTTAGTGCTTCCAAAGATTATAATGCATATAAAACA
ATTTGAGGATTATCTTGTTCTTAGGTGAAAAACAGTTTTTTTCCCATTTGAAATTAGATAAA
CAGAGTAGTTGTAGATTTCTACTGTGGAAAGCATAACATGTCTAAGCTGGTTAAATATACTT
AATTGATGGTTTTTGTCATTAAAGTAATTTCTTTGCATACATTTTTATGTTCTCATGTTATT
GCTTAATCGGAAAGGGGTTCTATAAAATGGATGGCATTTTATGGGATTCCGAGAAGCCTTTT
```

FIGURE 9 (continued)

```
TCTTTTTTTTGCCAGGGTGGGGGGTTTGCATTATTTGTCATAATGTTTTTTCTTTTGGAATG
CAGTATCCACCATATGTTCCCACCATAACCAACTATACTAAGGTTTGGTGGGTTCCTAATGT
TGTTGTGGCTCATCTAAAGGAGGGGATAGAAGTCCTTCATCTGGCATCTGGTCGAACACTAT
GTAAGGTAAATATAAAGCCACTGATCAGCTTGAAAATCAAAATACAAAAAAAAAAAAAAAAA
GTTTACAAGTAGTTGTACAACATTTGCTCCTGTGGTTGTAGATTTGTAGTATTAAACTGCCA
TGGTTTCAGCCAAAATCTTATTTAGCATTCACGTTACTTTTGAAATTTTTCGTATTCTGTGA
AATGACACTTCTATTTATCTCAGCTTCACCTTCAGGAAGGTGGTCTACATGCTGATATTAAT
GGTGATGGAGTTCTGGATCATGTGCAGGTTCACTTTTTTCCTTCACATTTTTGATAAACA
AACAAGCCAAATCTTTATTAATTTAGCATGATAATTGTTAACTTAACGGGGGATTTTCCTCT
GCCTGATGTCTGAAAGATTTATCTAATCAGGCTGTTGGAGGAAATGGTGCTGAGCAAACTGT
AGTTAGTGGGTCCATGGATGTTCTACGTCCTTGTTGGCTGTTGCAACGTCTGGCGTACCAG
TACGGGAACAACTCTTCAATGTATCTATTTGTCATTATACCCATTTTAACTTATTCCAACAT
GGAGAACTTTATAGAGGCTTCAACCGAGGTTCAGATATGTCTTCTTTGGAGGTAGCAACACC
CATTCTCATTCCTAGAAGCGATGGTCACAAGCACCGGAAGGGAAGCCACGGGGATGTTATCT
TCTTGACAAACCGGGGAGAGGTACGCTCTTTTTGTTCGACTAAATCTGGTTATGTAACATT
TGATAGTTTGTTTGAGCACCAATCAAACAAACCTAGTTCTTAACTTCTGTTAACAAATTATT
TCAAGTCACGCACGACTAATATATTTGGTGGTATTTGTGAGATAATCCGTACCTCCGTACT
GACTTTATGAAAATTGCTCCTTGCAGATAACTTCGCACACTCCTGGTTTGCATGGTCATGAT
GCTGTTTGGCAGTGGCAACAATCAACTGGTGTCACATGGTCAAACCTACCTTCCCCAGCAGG
GATGATGGAAGGTGGTTTGGTGATTCCCACACTAAAGCCTTTTCCTTTGCGGTTGCATGACA
ATCATGAGATGATCCTTGCAGCTGGAGAACAAGAGGCTGTGGTAATATCACCCGGAGGTAGC
ATATTGGCTACAATTGAACTCCCTGGTTCACCTACACATGTATTGATCCGTGAAGACTTCTC
AAATGATGGGCTCACTGACCTTATTCTCGTCACCTCATCCGGAGTGTACGGCTTTGTCCAGA
CTCGACAACCTGGTGCTCTCTTCTTCAGTGTGCTGATCGGCTGTCTCATAGTCGTGATGGGA
ATTATATTTGTTACCCAGCACATAAATTCCATGAAGGGGAAGCCTCGTCCATCATCTGGTCC
TAGGTGAAATGCAGGACCTGAAATTTATACATTAACTTTGCAGGCGCTTACAGATGAAGCAG
AAGACAAAGCGGTGTGCGCATCGTATGGAGCTTCAAGATTGTTGGAAATGCATAGAATGTAA
GGAGATTTTGAGGAGGTGTTGTACTGTCTAGGATGGATGATTGTAAAATTTAGACAGAAGTG
ACAGAATGTCCTTCATGAGAGAAACATGATCCATTAATATAAGGAAACTATAGTCTTTGCCT
ACGTATCTGGCTGTTGTTTAGAAGTTATACTGCCCACACTTGACAATTGTCACCCGTTCCGA
ATTAGTTGATACTTGATAGTTGATGCATAACAGAAACTCACCTTGGTCTTTACACTTTTCGC
TAAAAGGATTTTCTCTTGTCATTACACAATTCTTGTAAATACGACCATCGTTTATTTGCTTC
AGATTTAGCAGTGTAAAACATTAAATCTAGCAACCAACTTGCTCCAATCTGTCTTGGTCTTC
TTCAGAATACACTTCTTAAAAGTCAATTAAGAAATGACTTCCTGATTCCATCAAATTACCAA
TGTGGTTGATCCCATCATACATCAAGTGCTATGTACGTAATCCCTGTTAGTCTTTGGCATCA
CCTTAAGTGTTTTAGCTATTGCTTTTCCTGTGCGTCGAGAAATGTTTCAAATAACCATCTGA
ATGATTCAATATTGCATCATATAATATTGCAAACCCAAAATTAGTGTGTTCCTATAATGGAT
AAAGCTTGAAAATAATGCGAGTGGTCGATTAGTGCGATTGGTGCAATGTTGGATTCATTAAC
AACTGGTATTGAAAATATTGCATAAAGCTATCAACTTCTCCATATACCATGCTACATTGTCT
TTTGCCTGATGATGATTTTTGACATCCAACCGTGTAAATACAATATTAGT
```

SEQ ID NO: 73, Medicago sativa FG-GAP homologue, peptide comprising an FG-GAP domain
IQQDGGVSFKDAWMHLTDEYPIKYEAERLPPPVVADLNGDGKKEVLVATHDAKIQVL SEQ ID NO: 74, Medicago sativa FG-GAP homologue, peptide comprising the conserved motif 2
LSQLHLQEGGLHADINGDGVLDHVQ

FIGURE 9 (continued)

SEQ ID NO: 75, *Medicago sativa*, peptide of FG-GAP homologue
QAVGGNGAEQTVVSGSMDVLRPCWAVATSGVPVREQLFNVSICHYTHFNLFQHGELYRGFNR
GSDMSSLEVATPILIPRSDGHKHRKGSHGDVIFLTNRGEVRSFLF SEQ ID NO: 76, *Medicago sativa* FG-GAP homologue, peptide comprising a transmembrane domain
QITSHTPGLHGHDAVWQWQQSTGVTWSNLPSPAGMMEGGLVIPTLKPFPLRLHDNHEMILAA
GEQEAVVISPGGSILATIELPGSPTHVLIREDFSNDGLTDLILVTSSGVYGFVQTRQPGALF
FSVLIGCLIVVMGIIFVTQHINSMKGKPRPSS

FIGURE 9 (continued)

After Werck-Reichhart & Feyereisen (2000) Cytochromes P450: a success story. Genome Biology 1(6):REVIEWS3003

From Choe et al (1998) Plant Cell 10(2):231-43

N-terminal hydrophobic anchor domain

N-terminal hydrophobic anchor domain

```
                              1                                                  50
        Orysa_CYP90B   (1)  -----------MAAMMASITSELLFFLPFILLALLTFYTTTVAKCHGGHW
  Arath_CYP90B1_DWF4   (1)  ---------------MFETEHHTLLPLLLLPSLLSLLLFLILL---------
        Sacof_CYP90B   (1)  -----------MGAMMASITSELLFFLPFILLALLALYTTTVAKCDGTHQ
        Allce_CYP90B   (1)  ------------------MEIILVSTLIISLLIFLGFRSNGKTE---
        Zinel_CYP90B   (1)  ---------MCSTTLNMCDLEFFILASCLVLALFLILKLV---------
        Medtr_CYP90B   (1)  -------------------MSNSYLTCSFLSSIFVLSLIFIFI---------
        Poptr_CYP90B   (1)  ------------------MSHSELVVFLLPSILSLLLLFILVQ---------
 Aqufo_CYP90B partial  (1)  ------------------MPELVFFFSLAPAILALILLLKLF---------
 Triae_CYP90B partial  (1)  -----------MAAIMASITSELLFFLPFILLALLTFYTSAVAKCHGLHW
 Eupes_CYP90B partial  (1)  --------------------------------------------------
 Goshi_CYP90B partial  (1)  ------------------MPDSEPIFLLLPSILSLILFFILI---------
 Lyces_CYP90B partial  (1)  --------------------------------------------------
     Arath_CYP90A1_CPD (1)  ------------------------MAFTAFLLLLSSIAAGFLLLL-----
    Arath_CYP90C1_ROT3 (1)  MQPPASAGLFRSPENLPWPYNYMDYLVAGFLVLTAGILLRPWLWLRLRNS
        Arath_CYP90D1  (1)  ------------------MDTSSSLLFFSFFFFIIIVIFNKINGLRSSPA Consensus   (1)                  S      L    LLALLLI
```

Transition domain [Globular domain ->

```
                             51                                                  100
        Orysa_CYP90B  (40)  WRGGTTPAKRHR------MNLPPGAA-GWPLVGETFGYLRAHPATSVGR
  Arath_CYP90B1_DWF4  (29)  --------KRRNRKTR----FNLPPGKS-GWPFLGETIGYLKPYTATTLGD
        Sacof_CYP90B  (40)  W----RREKKKR------PNLPPGAL-GWPFVGETFGYLRAHPATSVGL
        Allce_CYP90B  (27)  --------RKLL------PTLPPGNLGGWPFIGDTIPFMTPHSSALLGT
        Zinel_CYP90B  (32)  --------KRRTNNGST--RNLPPGM-GWPFIGETIGYLQPYSATTIGK
        Medtr_CYP90B  (25)  --------KRKKTR-----YNLPPGKM-GWPFIGETIGYLKPYTATTMGE
        Poptr_CYP90B  (26)  --------RKQVR------FNLPPGNM-GWPFLGETIGYLKPYSATSIGE
 Aqufo_CYP90B partial (25)  --------KRKKKS-----YNLPPGNM-GWPYLGETLGYLKPYCAITTGD
 Triae_CYP90B partial (40)  WSG---RIKKRR-------PNLPPGAV-GWPFIGETFGYLRAHPATSIGQ
 Eupes_CYP90B partial (1)   --------------------------------------------------
 Goshi_CYP90B partial (25)  --------KRKQRR-----YNLPPGNM-GWPFLGETIGYLRPYSATSVGE
 Lyces_CYP90B partial (1)   ----------------------------M-GWPFLGETIGYLRPYSATTIGD
     Arath_CYP90A1_CPD(22)  --------RRTRYRR----MGLPPGSL-GLPLIGETFQLIGAYKTENPEP
    Arath_CYP90C1_ROT3(51)  KTKDGEEEDN----EEKKKGMIPNGSLGWPVIGETLNFIACGYSSRPVT
        Arath_CYP90D1 (33)  SKKKLNDHHVT----SQSHGPKFPHGSLGWPVIGETIEFVSSAYSDRPES Consensus  (51)          KR            NLPPG M GWPFIGETIGYLRPY ATSIG
```

Globular domain

```
                             101                                                150
        Orysa_CYP90B  (82)  FMEQHIARYGKIYRSSLFGERTVVSADAGLNRYILQNEGRLFECSYPRSI
  Arath_CYP90B1_DWF4  (67)  FMQQHVSKYGKIYRSNLFGEPTIVSADAGLNRFILQNEGRLFECSYPRSI
        Sacof_CYP90B  (78)  FMEQHVARYGKIYRSSLFGERTVVSADAGLNRYILQNEGRLFECSYPRSI
        Allce_CYP90B  (62)  YIDQNISKYGRIFRMNLLGKATIVSVDPDFNRYILQNEGRLFENSCPTSI
        Zinel_CYP90B  (71)  FMEQHISKYGKIYKSSLFGEPTIVSADPGLNKYILQNEGRLFECSYPRSI
        Medtr_CYP90B  (61)  FMENHIARYGTIYKSNLFGGPAIVSADAELNRFILQNDGKLFECSYPKSI
        Poptr_CYP90B  (61)  FMEQHISRYGKIYKSNLFGEPTIVSADAGLSRFILQNEGRLFECSYPKSI
 Aqufo_CYP90B partial (61)  FMEQHISRYGKIYKSNLFGYPTIVSVDPELNRYVLQNEGRLFECSYPSSL
 Triae_CYP90B partial (79)  FMDQHIARYGKIYRSSLFGDRTVVSADAGLNRYILQNEGRLFECSYPRSI
 Eupes_CYP90B partial (1)   --------------------------------------------------
 Goshi_CYP90B partial (61)  FMHQHISRYGNIYKSNLFGEKTIVSADAGLNKFILQNEGRLFECSYPRSI
 Lyces_CYP90B partial (24)  FMQDHISRYGKIFKSNLFGEPTIVSADAGLNRYILQNEGRLFECNYPRSI
     Arath_CYP90A1_CPD(59)  FIDERVARYGSVFMTHLFGEPTIFSADPETNRFVLQNEGKLFECSYPASI
    Arath_CYP90C1_ROT3(97)  FMDKRKSLYGKVFKTNIIGTPIIISTDAEVNKVVLQNHGNTFVPAYPKSI
        Arath_CYP90D1 (79)  FMDKRRLMYGRVFKSHIFGTATIVSTDAEVNRAVLQSDSTAFVPFYPKTV Consensus (101)  FMEQHISRYGKIYKSNLFGEPTIVSADAGLNRYILQNEGRLFECSYPRSI
```

FIGURE 13

Globular domain

```
                              151                                                   200
       Orysa_CYP90B   (132)  GGILGKWSMLVLVGDPHREMRAISLNFLSSVRLRAVLLPEVERHTLLVLR
  Arath_CYP90B1_DWF4  (117)  GGILGKWSMLVLVGDMHRDMRSISLNFLSHARLRTILLKDVERHTLFVLD
       Sacof_CYP90B   (128)  GGILXKWSMLVLVGDAHREMRAISLNFLSSVRLRAVLLPEVERHTLLVLR
       Allce_CYP90B   (112)  KEILGKWSMLALAGDIHREMRSIAVNFMNSVKLRTYFLKDIDIQAVNILD
       Zinel_CYP90B   (121)  GGILGKWSMLVLVGDMHRDMRQISLNFLSNARLKTQLVNEVEKNTLWVLD
       Medtr_CYP90B   (111)  GGILGKWSMLVLVGDMHREMRNISLNFMSYARLKTHFLKDMEKHTLFVLS
       Poptr_CYP90B   (111)  GGILGKWSMMVLVGDMHRDMRIISLNFLSHARLRTHLLKEVEKQTLLVLS
  Aqufo_CYP90B partial (111) GGILGKWSMLVLVGDMHKNMRMISVNFMSSARLRTHLIQDVETQALLVLK
  Triae_CYP90B partial (129) GGILGKWSMLVLVGDPHREMRFISLNFLSSVRLRAVLLPEVERHTLLVLR
  Eupes_CYP90B partial   (1) --------------------------------------------------
  Goshi_CYP90B partial (111) GGILGKWSMLVLVGDMHRDMRIISLNFLSNARLRTHLLREVEKHTLLVLN
  Lyces_CYP90B partial  (74) GGILGKWSMLVQVGQMHRDMRMISLNFLSNARLRNQLLSEVEKHTLLVLG
      Arath_CYP90A1_CPD (109) CNLLGKHSLLLMKGSLHKRMHSLTMSFANSSIIKDHLMLDIDRLVRFNLD
     Arath_CYP90C1_ROT3 (147) TELLGENSILSINGPHQKRLHTLIGAFLRSPHLKDRITRDIEASVVLTLA
           Arath_CYP90D1 (129) RELMGKSSILLINGSLHRRFHGLVGSFLKSPLLKAQIVRDMHKFLSESMD Consensus    (151) GGILGKWSMLVLVGDMHRDMR ISLNFLSSARLR  LL DVEK TLLVL
```

Globular domain

```
                              201                                                   250
       Orysa_CYP90B   (182)  AWPPSS---TFSAQHQAKKFTFNLMAKNIMSMDPGEEETERLRREYITFM
  Arath_CYP90B1_DWF4  (167)  SWQQNS---IFSAQDEAKKFTFNLMAKHIMSMDPGEEETEQLKKEYVTFM
       Sacof_CYP90B   (178)  SWPPSDG--TVSAQHQAKKFTFNLMAKNIMSMDPGEEETERLRLEYITFM
       Allce_CYP90B   (162)  AWKVNS---TFSAQDEGKKFAFNLMVKHLMNMDPGMPETEEIRKEYIFFM
       Zinel_CYP90B   (171)  SWKENS---PFCAQEEAKKFTFNLMATHIMSLDPGEPETERLKKEYVTFM
       Medtr_CYP90B   (161)  SWKENC---TFSAQDEAKKFTFNLMAKQIMSLDPGNLETEQLKKEYVCFM
       Poptr_CYP90B   (161)  SWKENC---TFSAQDEANKFTFNWMAKHIMSLDPGKTETEQLKKEYVTFM
  Aqufo_CYP90B partial (161) SWQVDK---KILAQDEAKKFTFNLIVKNIMSMEPGTPESEKLRREYITFM
  Triae_CYP90B partial (179) DWLPYSSSSVFSAQHEAKKFTFNLMAKNIMSMDPGXXXXXXXXXXXXXXX
  Eupes_CYP90B partial   (1) -------------------------SMDPGKPETEKLKKEYVTFM
  Goshi_CYP90B partial (161) TWKEKC---IFSAQDEAKKFTFNLMAKNIMSMDPGHPETEQLKKEYITFM
  Lyces_CYP90B partial (124) SWKQDS---VVCAQDEAKKLTFNFMAEHIMSLQPGNPETEKLKKEYITFM
      Arath_CYP90A1_CPD (159) SWSSRV------LLMEEAKKITFELTVKQLMSFDPG-EWSESLRKEYLLVI
     Arath_CYP90C1_ROT3 (197) SWAQLP---LVHVQDEIKKMTFEILVKVLMSTSPG-EDMNILKLEFEEFI
           Arath_CYP90D1 (179) LWSEDQ---PVLLQDVSKTVAFKVLAKALISVEKG-EDLEELKREFENFI Consensus    (201) SW           FSAQDEAKKFTFNLMAK IMSMDPG  ETE LKKEYVTFM
```

Globular domain

```
                              251                                                   300
       Orysa_CYP90B   (229)  KGVVSAPLNLPGTPYWKALKSRAAILGVIERKMEERVEKLSKEDASVE--
  Arath_CYP90B1_DWF4  (214)  KGVVSAPLNLPGTAYHKALQSRATILKFIERKMEERKLDIKEEDQEEEEV
       Sacof_CYP90B   (226)  KGVVSAPLNFPGTAYWKALKSRASILGVIERKMEDRLQKMSKENSSVE--
       Allce_CYP90B   (209)  EGMASIPLNFPGTAYRRALQSRSRILAIMGQKLDERMQKIKEGCKGLE--
       Zinel_CYP90B   (218)  KGVVSPPLNFPGTAYWKALKSRATILKFIETKMEERIRMDEGNGLGKL--
       Medtr_CYP90B   (208)  KGVVSAPLNLPGTAYRKALKSRNNILKFIEGKMEERVKRNQEGKKGMB--
       Poptr_CYP90B   (208)  KGVVSGPINFPGTPYRKALKSRSIILKFIERKMERIGETKGGVENLE--
  Aqufo_CYP90B partial (208) KGIISAPLNLPGTAYRRALKSRSNILQLIEHNMNERLQKTNGDGKKVE--
  Triae_CYP90B partial (229) XXXXXXXXXXXXXXXXALKSRATILGVIERKMEERLEKMNKEASSME--
  Eupes_CYP90B partial  (21) KGVVSAPINLPGTAYRRALQSRSTILKFIEEKMEERNEKLKEGKAEEE--
  Goshi_CYP90B partial (208) KGVVSAPLNLPGTAYRKALQSRSTILKFIEKKMEVRIRKMKEGKENSE--
  Lyces_CYP90B partial (171) KGVVSAPLNFPGTAYRKALQSRSTILGFIERKMEERLKEMNRN------
      Arath_CYP90A1_CPD (203) EGFFSLPLPLFSTTYRKAIQARRKVAEALTVVVMKRREEEEEGAERKK--
     Arath_CYP90C1_ROT3 (243) KGLICIPIKFPGTRLYKSLKAKERLIKMVKKVVE----ERQVAMTTTS--
           Arath_CYP90D1 (225) SGLMSLPINFPGTQLHRSLQAKKNMVKQVERIIEGKIRKTKNKEEDDV- Consensus    (251) KGVVSAPLN PGTAYRKALKSRS ILK IERKMEERI KM         E
```

FIGURE 13 (continued)

Globular domain

A domain

```
                              301                                              350
       Orysa_CYP90B     (277) ---------------QDDLLGWALKQSNLSKEQI------LDLLLS
 Arath_CYP90B1_DWF4     (264) KTEDEAEMSKSDHVRKQRTDDDLLGWVLKHSNLSTEQI------LDLILS
       Sacof_CYP90B     (274) ---------------EDDLLGWALKQSNLSKEQI------LDLLLS
       Allce_CYP90B     (257) ---------------EEDLLASVARNTNITRDQI------LDLMIS
       Zinel_CYP90B     (266) ---------------DNDLLGWSMKNSNLTKEQI------LDLVLS
       Medtr_CYP90B     (256) ---------------ENDLLNWVLKHSNLSTEQI------LDLILS
       Poptr_CYP90B     (256) ---------------DDDLLGWVLKHSNLYTEQI------LELILS
Aqufo_CYP90B partial    (256) ---------------DDDLLGWVLKHSNLTTEQI------LDLILS
Triae_CYP90B partial    (277) ---------------EDDLLGWAMKQSNLSKEQI------LDLLLS
Eupes_CYP90B partial    (69)  ---------------EEDDLLGWVLKHSNLSTEQI------LDLVLS
Goshi_CYP90B partial    (256) ---------------EDDLLEWVLKHSNLSTEQI------LDLILS
Lyces_CYP90B partial    (214) ---------------ENDLLGWVLKNSNLSKEQI------LDLLLS
   Arath_CYP90A1_CPD    (251) ----------------DMLAALLAADDGFSDEEI------VDFLVA
   Arath_CYP90C1_ROT3   (287) ----------------PANDVVDVLLRDGGDSEKQSQPSDFVSGKIVE
       Arath_CYP90D1    (273) ----------------IAKDVVDVLLKDSSEHLTHN----LIANNMID Consensus     (301)               EDDLLGWVLK SNLS EQI       LDLILS
```

Globular domain

A domain (con t'd)

```
                              351                                              400
       Orysa_CYP90B     (302) LIFAGHETSSMALALAIFFLEGCPKAVQELREEHLGIARRQRLRGECK-L
 Arath_CYP90B1_DWF4     (308) LIFAGHETSSVAIALAIFFLQACPKAVEELREEHLEIARAKKEIGESB-L
       Sacof_CYP90B     (299) LIFAGHETSSMALALAIFFLEGCPKAVQELREEHLEIARRQRLRGAFK-L
       Allce_CYP90B     (282) MIFAGHETSSAAISLAIYFLQASPDVLKKLREEHIKIAKQKKERGETB-L
       Zinel_CYP90B     (291) LIFAGHETSSVSISLAVYFLEACPTAVRQLREEHEEIVMKKKLIGEKY-L
       Medtr_CYP90B     (281) LIFAGHETSSVAIALAIYFLPSCPQAIQQLREEHREIARSKKKAGEVE-L
       Poptr_CYP90B     (281) LIFAGHETSSVSIALAISFLQACPGSIQQLKEEHIQISRAKKRSGETB-L
Aqufo_CYP90B partial    (281) MIFAGHETSSVSISLAIYLLQGCLKAVEELREEHIRIAKAKEQAGQRSGL
Triae_CYP90B partial    (302) LIFAGHETSSMALAIAIFFLEGCPKAVEELREEHLEIARRQKLRGECK-L
Eupes_CYP90B partial    (95)  LNFAGHETSSVAILXAIYFLQDSPAALQQLREEHKEIEKAKKQSGEKG-L
Goshi_CYP90B partial    (281) LIFAGHETSSVAITLAIYFLPGCPLAIQQLRENTLKLQSQTNQRDX---L
Lyces_CYP90B partial    (239) LIFAGHETSSVAIALSIFLLESCPAAVQQLTEEHLEISR----------
   Arath_CYP90A1_CPD    (275) LLVAGYETTSTIMTLAVKFLTETPLALAQLKEEHEKIRAMKSDSYS---L
   Arath_CYP90C1_ROT3   (319) MMIPGEETMPTAMTLAVKFLSDNPVALAKLVEENMEMKRRKLEIG-EEY
       Arath_CYP90D1    (301) MMIPGHDSVPVLITLAVKFLSDSPAALNLLTEENMKLKSLKELTG-EPL Consensus     (351) LLFAGHETSSVAIALAIYFL GCP AVQ LREEHLEIAR KK    GE    L
```

Globular domain

B domain | C domain

```
                              401                                              450
       Orysa_CYP90B     (351) SWEDYKEMVFTQCVINETLRLGNVVRFLHRKVIKDVHYKGYDIPSGWKII
 Arath_CYP90B1_DWF4     (357) NWDDYKKMDFTQCVINETLRLGNVVRFLHRKALKDVRYKGYDIPSGWKVL
       Sacof_CYP90B     (348) SWEDYKEMVFTPWCINETLRVGNVVRFLHRKVIQDVHYNGYDIPRGWKII
       Allce_CYP90B     (331) NWDDYKQMEFTNCVIHETLRLGNIVKFLHRKTIKDVQYKGYEIPCGWEVV
       Zinel_CYP90B     (340) TWDDYKKMEFTQCVINETLRFGNVVRFLHRKAIKDVRYKGYDIPCGWKVI
       Medtr_CYP90B     (330) TWDDYKRMEFTHCVVNETLRLGNVVRFLHRKAIKDVRYKGYDIPCGWKVI
       Poptr_CYP90B     (330) TWDDYKKMEFTQCVISETVRLGNVVRFVBRKALKDVRYKGXDIPCGWKVL
Aqufo_CYP90B partial    (331) NWEDYKHMEFTQCX----------FLHRKTLKDVQYKGYDIPCGWKVL
Triae_CYP90B partial    (351) SWEDYKEMVFTQCVINETLRLGNVVRFLHRKVIRDVHYNGYDIPSGWKII
Eupes_CYP90B partial    (144) NWDVYKNMEFTQCVINETLRLGNVVRFLHRKTIKHVQYKGYDIPRGWKVL
Goshi_CYP90B partial    (328) NWDDTE-------------------------------------------
Lyces_CYP90B partial    (278) -------------------------------------------------
   Arath_CYP90A1_CPD    (322) EWSDYKSMPFTQCVVNETLRVANIIGGVFRRAMTDVEIKGYKIPKGWKVF
   Arath_CYP90C1_ROT3   (367) KWTDYMSLSFTQNVINETLRMANIINGVWRKALKDVEIKGYLIPKGWCVL
       Arath_CYP90D1    (349) YWNDYLSLPFTQKVITETLRMGNVIIGVMRKAMKDVEIKGYVIPKGWCFI Consensus     (401) WDDYK M FTQCVINETLR LGNVVRFLHRK IKDV YKGYDIP GWKVI
```

FIGURE 13 (continued)

Globular domain

C domain (cont'd)

```
                              451                                              500
      Orysa_CYP90B    (401)  PVLAAVHLDSSLYEDPQRFNPWRWKSSGS SGGLAQS------------- -S
Arath_CYP90B1_DWF4    (407)  PVISAVHLDNSRYDQPNLFNPWRWQQQNN GASSSGSGSFSTWG----- -N
      Sacof_CYP90B    (398)  PVLAAVHLDSSLYKDPYRFNPWRWKSNAP ------------------- -S
      Allce_CYP90B    (381)  PIISAAHLDSSIFDNPKVMNPSRWEAIFS AGAK--------------- -S
      Zinel_CYP90B    (390)  PVIAAVHLDPTHFDQPYLFDPWRWQNASV TSSTCSTPPSA-------- -S
      Medtr_CYP90B    (380)  PVISAVHLDPSNFDQPQHFNPWRWQQNND GASGNS------------- -N
      Poptr_CYP90B    (380)  PVISSVHLDSTLFDQPQHFNPWRWQQHNN ARGSSTCSSAAAAAAAAV SSN
Aqufo_CYP90B partial  (369)  PVFAAVHLDPLNFDQPHAFNPWRWQNGKT STTT--------------- -N
Triae_CYP90B partial  (401)  PVLAAVHLDSSLYEDPSSFNPWRWKGNAS GVAQN-------------- -S
Eupes_CYP90B partial  (194)  PVIAAVHLDSSHFEKPQHFNPWRWLHQNN GIQNMN------------- -N
Goshi_CYP90B partial  (334)  --------------------------------------------------
Lyces_CYP90B partial  (278)  --------------------------------------------------
    Arath_CYP90A1_CPD (372)  SSFRAVHLDPNHFKDARTFNPWRWQSNSV TTGPSN------------- --
   Arath_CYP90C1_ROT3 (417)  ASFISVHMDEDIYDNPYQFDPWRWDRING SANSSI------------- --
         Arath_CYP90D1 (399) AYLRSVHLDKLYYESPYKFNPWRWQERDM NTSS--------------- --

Consensus   (451)  PVIAAVHLD S FD P  FNPWRW
```

Globular domain

D domain (cont'd)

```
                              501                                              550
      Orysa_CYP90B    (438)  SFMPYGGGTRLCAGSELAKLEMAVFLHHLVLNFRWELAEPDQAFVFPFVD
Arath_CYP90B1_DWF4    (451)  NYMPFGGGPRLCAGSELAKLEMAVFIHHLVLKFNWELAEDDQPFAFHVD
      Sacof_CYP90B    (428)  SFMPYGGGPRLCAGSELAKLEIAIFLHHLVLNFRWELAEPDQAFVYPFVD
      Allce_CYP90B    (415)  NIMSFSGGPRLCPGAELAKLEMAIFLHHLVQRFDWELVEKDNPVSFPFLG
      Zinel_CYP90B    (431)  NFMPFGGGPRLCTGSELAKLEMAIFIHHLVLKYEWELVDSDEAFAYPYLD
      Medtr_CYP90B    (416)  IFLPFGGGPRLCAGLELAKLEMAVFIHHIILKYNWDMVDVDQPIVYPFVD
      Poptr_CYP90B    (430)  HFMPFGGGPRLCAGSELAKLEMAVFIHHLVLNFHWELVGADQAFAFPFVD
Aqufo_CYP90B partial  (403)  NFMPFGGGLRLCAGSELAKLEMAIFIHHLVLNYDWDIAEPDQPFAYPFVE
Triae_CYP90B partial  (436)  NFMPYGGGTRLCAGSELAKLEMAVFLHHLVLNFRWELAEPDQAFVYPFVD
Eupes_CYP90B partial  (230)  NFMPFGGGPRLCAGSELAKLEMAIFIHHLVLNYQ----------------
Goshi_CYP90B partial  (334)  --------------------------------------------------
Lyces_CYP90B partial  (278)  --------------------------------------------------
    Arath_CYP90A1_CPD (407)  VFTPFGGGPRLCPGYELARVALSVFLHRLVTGFSWVPAEQDKLVFFPTTR
   Arath_CYP90C1_ROT3 (452)  CFTPFGGGQRLCPGLELSKLEISIFLHHLVTRYSWT-AEEDEIVSFPTVK
         Arath_CYP90D1 (432) -FSPFGGGQRLCPGLDLARLETSVFLHHLVTRFRWI-AEEDTIINFPTVH Consensus   (501)  FMPFGGGPRLCAGSELAKLEMAIFLHHLVL F WELAE DQ  FPFVD
Domain D consensus sequence  FXXGRXCXG
```

Globular domain

```
                              551                                              60
      Orysa_CYP90B    (488)  FPKGLPIRVHRIAQDDEQE-------------------------------
Arath_CYP90B1_DWF4    (501)  FPNGLPIRVSRIL-------------------------------------
      Sacof_CYP90B    (478)  FPKGLPIRVQRIADDQGASQRFDREARCSGTGTQASTKFSLHFEGIGAGWLW
      Allce_CYP90B    (465)  FPKKLPIKITALKH------------------------------------
      Zinel_CYP90B    (481)  FPKGLPIKIRHRKQSC----------------------------------
      Medtr_CYP90B    (466)  FPKGLPIRVQSQATL-----------------------------------
      Poptr_CYP90B    (480)  FKKGLPIRVKHHTVI-----------------------------------
Aqufo_CYP90B partial  (453)  FPKGLPIKVYDHQCLT----------------------------------
Triae_CYP90B partial  (486)  FPKGLPIRVHRIAQEEEGEED-----------------------------
Eupes_CYP90B partial  (264)  --------------------------------------------------
Goshi_CYP90B partial  (334)  --------------------------------------------------
Lyces_CYP90B partial  (278)  --------------------------------------------------
    Arath_CYP90A1_CPD (457)  TQKRYPIFVKRRDFAT----------------------------------
   Arath_CYP90C1_ROT3 (501)  MKRRLPIRVATVDDSASPISLEDH--------------------------
         Arath_CYP90D1 (480) MKNKLPIWIKRI--------------------------------------

Consensus   (551)  FPKGLPIRV
```

FIGURE 13 (continued)

SEQ ID NO: 77, Oryza sativa CYP90B nucleic acid sequence AB206579.1
ATGGCCGCCATGATGGCGTCCATAACCAGCGAGCTGCTCTTCTTTCTCCCCTTCATCCTCCT
TGCCCTGCTCACGTTCTACACCACCACCGTGGCCAAATGCCACGGCGGGCACTGGTGGCGAG
GTGGGACGACGCCGGCGAAGAGGAAGCGGATGAACCTGCCGCCCGGCGCCGCCGGGTGGCCG
CTCGTCGGCGAGACGTTCGGCTACCTCCGCGCCCACCCCGCCACCTCCGTCGGCCGCTTCAT
GGAGCAGCACATCGCACGGTACGGGAAGATATACCGGTCGAGCCTGTTCGGGGAGCGGACGG
TGGTGTCGGCGGACGCGGGGCTCAACCGGTACATCCTGCAGAACGAGGGGAGGCTGTTCGAG
TGCAGCTACCCGCGCAGCATCGGCGGCATCCTGGGCAAGTGGTCCATGCTGGTCCTCGTCGG
GGACCCGCACCGCGAGATGCGCGCCATCTCCCTCAACTTCCTCTCCTCCGTCCGCCTCCGCG
CCGTCCTCCTCCCCGAGGTCGAGCGCCACACCCTCCTCGTCCTCCGCGCCTGGCCCCCTTCC
TCCACCTTCTCCGCTCAGCACCAAGCCAAGAAGTTCACGTTCAACCTGATGGCGAAGAACAT
AATGAGCATGGACCCGGGGGAGGAAGAGACGGAGCGGCTGCGGCGGGAGTACATCACCTTCA
TGAAGGGCGTGGTCTCCGCGCCGCTCAACCTGCCCGGGACGCCCTACTGGAAGGCTCTCAAG
TCGCGTGCTGCCATTCTCGGAGTAATAGAGAGGAAAATGGAAGAGCGGGTTGAGAAGCTGAG
CAAGGAGGATGCAAGCGTAGAGCAAGACGATCTTCTCGGATGGGCTCTGAAACAATCTAACC
TTTCAAAAGAGCAAATCCTGGACCTCTTGCTGAGCTTGCTCTTCGCCGGGCACGAGACGTCG
TCCATGGCGCTCGCCCTCGCCATCTTCTTCCTTGAAGGCTGCCCCAAGGCTGTCCAAGAACT
GAGGGAGGAGCATCTTGGGATTGCAAGGAGACAAAGGCTAAGAGGGGAGTGCAAATTGAGCT
GGGAAGACTACAAAGAGATGGTTTTCACGCAATGTGTCATAAACGAGACGTTGCGGCTAGGA
AACGTGGTCAGGTTCCTGCACCGGAAGGTCATCAAGGACGTGCACTACAAGGGTTATGACAT
TCCAAGCGGATGGAAGATCCTGCCGGTGTTAGCCGCGGTGCATCTGGACTCGTCCCTGTACG
AGGACCCCCAGCGCTTCAATCCCTGGAGATGGAAGAGTAGCGGATCATCCGGCGGCTTGGCT
CAGAGCAGCAGCTTCATGCCGTACGGCGGCGGGACGCGGCTGTGCGCCGGGTCGGAGCTCGC
GAAGCTGGAGATGGCCGTGTTCTTGCACCACCTGGTGCTCAACTTCAGGTGGGAGCTCGCCG
AGCCGGACCAAGCCTTCGTCTTCCCCTTCGTCGACTTCCCCAAGGGCCTTCCCATTAGGGTT
CATAGAATTGCACAGGATGATGAGCAGGAGTAA

SEQ ID NO: 78, Oryza sativa CYP90B amino acid sequence
MAAMMASITSELLFFLPFILLALLTFYTTTVAKCHGGHWWRGGTTPAKRKRMNLPPGAAGWP
LVGETFGYLRAHPATSVGRFMEQHIARYGKIYRSSLFGERTVVSADAGLNRYILQNEGRLFE
CSYPRSIGGILGKWSMLVLVGDPHREMRAISLNFLSSVRLRAVLLPEVERHTLLVLRAWPPS
STFSAQHQAKKFTFNLMAKNIMSMDPGEEETERLRREYITFMKGVVSAPLNLPGTPYWKALK
SRAAILGVIERKMEERVEKLSKEDASVEQDDLLGWALKQSNLSKEQILDLLLSLLFAGHETS
SMALALAIFFLEGCPKAVQELREEHLGIARRQRLRGECKLSWEDYKEMVFTQCVINETLRLG
NVVRFLHRKVIKDVHYKGYDIPSGWKILPVLAAVHLDSSLYEDPQRFNPWRWKSSGSSGGLA
QSSSFMPYGGGTRLCAGSELAKLEMAVFLHHLVLNFRWELAEPDQAFVFPFVDFPKGLPIRV
HRIAQDDEQ

SEQ ID NO: 79, Arabidopsis thaliana CYP90B1 nucleic acid sequence NM_114926.2
ATGTTCGAAACAGAGCATCATACTCTCTTACCTCTTCTTCTTCTCCCATCGCTTTTGTCTCT
TCTTCTCTTCTTGATTCTCTTGAAGAGAAGAAATAGAAAAACCAGATTCAATCTACCTCCGG
GTAAATCCGGTTGGCCATTTCTTGGTGAAACCATCGGTTATCTTAAACCGTACACCGCCACA
ACACTCGGTGACTTCATGCAACAACATGTCTCCAAGTATGGTAAGATATATAGATCGAACTT
GTTTGGAGAACCAACGATCGTATCAGCTGATGCTGGACTTAATAGATTCATATTACAAAACG
AAGGAAGGCTCTTTGAATGTAGTTATCCTAGAAGTATAGGTGGGATTCTTGGGAAATGGTCG
ATGCTTGTTCTTGTTGGTGACATGCATAGAGATATGAGAAGTATCTCGCTTAACTTCTTAAG

FIGURE 15

TCACGCACGTCTTAGAACTATTCTACTTAAAGATGTTGAGAGACATACTTTGTTTGTTCTTG
ATTCTTGGCAACAAAACTCTATTTTCTCTGCTCAAGACGAGGCCAAAAAGTTTACGTTTAAT
CTAATGGCGAAGCATATAATGAGTATGGATCCTGGAGAAGAAGAAACAGAGCAATTAAAGAA
AGAGTATGTAACTTTCATGAAAGGAGTTGTCTCTGCTCCTCTAAATCTACCAGGAACTGCTT
ATCATAAAGCTCTTCAGTCACGAGCAACGATATTGAAGTTCATTGAGAGGAAAATGGAAGAG
AGAAAATTGGATATCAAGGAAGAAGATCAAGAAGAAGAAGAAGTGAAAACAGAGGATGAAGC
AGAGATGAGTAAGAGTGATCATGTTAGGAAACAAAGAACAGACGATGATCTTTTGGGATGGG
TTTTGAAACATTCGAATTTATCGACGGAGCAAATTCTCGATCTCATTCTTAGTTTGTTATTT
GCCGGACATGAGACTTCTTCTGTAGCCATTGCTCTCGCTATCTTCTTCTTGCAAGCTTGCCC
TAAAGCCGTTGAAGAGCTTAGGGAAGAGCATCTTGAGATCGCGAGGGCCAAGAAGGAACTAG
GAGAGTCAGAATTAAATTGGGATGATTACAAGAAAATGGACTTTACTCAATGTGTTATAAAT
GAAACTCTTCGATTGGGAAATGTAGTTAGGTTTTTGCATCGCAAAGCACTCAAAGATGTTCG
GTACAAAGGATACGATATCCCTAGTGGGTGGAAAGTGTTACCGGTGATCTCAGCCGTACATT
TGGATAATTCTCGTTATGACCAACCTAATCTCTTTAATCCTTGGAGATGGCAACAGCAAAAC
AACGGAGCGTCATCGTCAGGAAGTGGTAGTTTTTCGACGTGGGGAAACAACTACATGCCGTT
TGGAGGAGGGCCAAGGCTATGTGCTGGTTCAGAGCTAGCCAAGTTAGAAATGGCAGTGTTTA
TTCATCATCTAGTTCTTAAATTCAATTGGGAATTAGCAGAAGATGATCAACCATTTGCTTTT
CCTTTTGTTGATTTTCCTAACGGTTTGCCTATTAGGGTTTCTCGTATTCTGTAA

SEQ ID NO: 80, Arabidopsis thaliana CYP90B1 amino acid sequence
MFETEHHTLLPLLLLPSLLSLLLFLILLKRRNRKTRFNLPPGKSGWPFLGETIGYLKPYTAT
TLGDFMQQHVSKYGKIYRSNLFGEPTIVSADAGLNRFILQNEGRLFECSYPRSIGGILGKWS
MLVLVGDMHRDMRSISLNFLSHARLRTILLKDVERHTLFVLDSWQQNSIFSAQDEAKKFTFN
LMAKHIMSMDPGEEETEQLKKEYVTFMKGVVSAPLNLPGTAYHKALQSRATILKFIERKMEE
RKLDIKEEDQEEEEVKTEDEAEMSKSDHVRKQRTDDDLLGWVLKHSNLSTEQILDLILSLLF
AGHETSSVAIALAIFFLQACPKAVEELREEHLEIARAKKELGESELNWDDYKKMDFTQCVIN
ETLRLGNVVRFLHRKALKDVRYKGYDIPSGWKVLPVISAVHLDNSRYDQPNLFNPWRWQQQN
NGASSSGSGSFSTWGNNYMPFGGGPRLCAGSELAKLEMAVFIHHLVLKFNWELAEDDQPFAF
PFVDFPNGLPIRVSRIL

SEQ ID NO: 81, Saccharum officinarum CYP90B nucleic acid sequence CA092707.1 CF574030.1 CA217329.1 compiled ESTs
ATGGGCGCCATGATGGCCTCCATAACCAGCGAGCTCCTCTTCTTCCTTCCCTTCATCCTGCT
GGCCCTCCTCGCCCTGTACACCACCACTGTCGCCAAATGCGACGGCACCCACCAGTGGCGCC
GGCCGAAGAAGAAGCGGCCGAACCTGCCCCGGGCGCCCTCGGATGGCCTTTCGTCGGCGAG
ACCTTCGGCTACCTCCGCGCCCACCCGGCCACCTCCGTGGGCCTCTTCATGGAGCAGCATGT
CGCACGGTACGGCAAGATATACCGGTCGAGCCTGTTCGGGGAGCGGACGGTGGTGTCGGCGG
ACGCGGGGCTCAACCGCTACATCCTGCAGAACGAGGGCGGCTGTTCGAGTGCAGCTACCCG
CGCAGCATCGGCGGCATCCTGNGCAAGTGGTCCATGCTGGTGCTGGTGGGCGACGCGCACCG
CGAGATGCGCGCCATCTCGCTCAACTTTCTCAGCTCCGTCCGCCTCCGCGCCGTGCTGCTCC
CGGAGGTGGAGCGCCACACCCTGCTGGTGCTCCGCTCATGGCCGCCCTCCGACGGCACGGTC
TCCGCGCAGCACCAAGCCAAGAAGTTCACGTTAACCTGATGGCGAAGAACATAATGAGCAT
GGACCCCGGCGAGGAGGAGACGGAGCGGCTGCGGCTGGAGTACATCACCTTCATGAAGGGCG
TCGTGTCAGCGCCGCTCAACTTCCCGGGCACGGCCTACTGGAAGGCGCTCAAGTCACGCGCG
TCCATACTTGGAGTAATAGAGAGGAAGATGGAGGACAGGCTTCAGAAAATGAGTAAGGAGAA
CTCAAGTGTGGAGGAAGACGATCTTCTTGGATGGGCCCTGAAGCAGTCCAATCTGTCAAAGG
AACAGATCCTGGACCTCTTGCTGAGCCTGCTCTTCGCCGGGCACGAGACTTCGTCAATGGCG FIGURE 15 (continued)

```
CTAGCCCTCGCCATCTTCTTCCTTGAAGGATGCCCCAAGGCTGTTCAAGAACTCCGGGAGGA
GCATCTCGAGATTGCTAGGAGACAAAGGCTAAGAGGGGCGTTCAAATTGAGCTGGGAAGACT
ACAAGGAAATGGTTTTCACGCCATGGTGTATAAACGAGACATTGCGGGTTGGCAACGTGGTC
AGGTTCCTGCACCGGAAGGTCATCCAAGATGTGCACTACAATGGGTACGACATACCACGCGG
GTGGAAAATCCTGCCGGTGTTAGCGGCGGTGCATCTGGATTCGTCGCTGTACAAGGACCCT
ACCGGTTCAACCCTTGGAGATGGAAGAGCAACGCGCCGAGCAGCTTCATGCCGTACGGCGGC
GGGCCGCGGCTGTGCGCCGGGTCGGAGCTGGCCAAGCTGGAGATCGCCATCTTCCTGCACCA
CCTGGTGCTCAACTTCCGGTGGGAGCTGGCGGAGCCGGACCAAGCCTTCGTCTACCCCTTCG
TCGACTTCCCCAAGGGCCTCCCGATCAGGGTCCAGCGGATCGCCGACGACCAGGGGCATCG
CAGCGTTTTGACCGAGAAGCACGATGTAGCGGTACGGGTACACAAGCAAGTACAAAATTTTC
GTTGCATTTTGAGGGAATTGGGGCTGGGTGGTTATGGTAA
```

SEQ ID NO: 82, Saccharum officinarum CYP90B amino acid sequence
```
MGAMMASITSELLFFLPFILLALLALYTTTVAKCDGTHQWRRPKKKRPNLPPGALGWPFVGE
TFGYLRAHPATSVGLFMEQHVARYGKIYRSSLFGERTVVSADAGLNRYILQNEGRLFECSYP
RSIGGILXKWSMLVLVGDAHREMRAISLNFLSSVRLRAVLLPEVERHTLLVLRSWPPSDGTV
SAQHQAKKFTFNLMAKNIMSMDPGEEETERLRLEYITFMKGVVSAPLNFPGTAYWKALKSRA
SILGVIERKMEDRLQKMSKENSSVEEDDLLGWALKQSNLSKEQILDLLLSLLFAGHETSSMA
LALAIFFLEGCPKAVQELREEHLEIARRQRLRGAFKLSWEDYKEMVFTPWCINETLRVGNVV
RFLHRKVIQDVHYNGYDIPRGWKILPVLAAVHLDSSLYKDPYRFNPWRWKSNAPSSFMPYGG
GPRLCAGSELAKLEIAIFLHHLVLNFRWELAEPDQAFVYPFVDFPKGLPIRVQRIADDQGAS
QRFDREARCSGTGTQASTKFSLHFEGIGAGWLW
```

SEQ ID NO: 83, Allium cepa CYP90B nucleic acid sequence TC2113
```
ATGGAGATCATATTAGTGTCTACATTGATCATATCGCTACTAATATTTCTTGGATTTAGAAG
CAATGGGAAAACGGAGAGAAAATTGCTGCCTACACTACCACCAGGCAATCTTGGAGGTTGGC
CATTCATCGGTGACACCATTCCGTTCATGACACCTCATTCTTCTGCTTTGTTGGGCACTTAC
ATCGATCAAAATATTTCCAAATATGGGAGGATATTTCGAATGAACTTGTTAGGAAAGGCAAC
GATCGTGTCTGTAGACCCTGATTTCAACAGATATATTCTACAGAATGAAGGAAGATTGTTTG
AAAATAGCTGCCCAACGAGCATTAAAGAGATTTTGGGAAAATGGTCTATGCTTGCATTAGCT
GGGGATATACACAGAGAAATGAGATCCATTGCTGTGAATTTCATGAACAGTGTTAAGCTTAG
AACTTATTTTTTAAAGGATATTGATATTCAGGCTGTTAATATTCTTGATGCTTGGAAGGTCA
ACTCTACTTTCTCTGCACAGGATGAAGGAAAGAAGTTTGCATTTAACCTCATGGTGAAGCAT
CTAATGAATATGGATCCTGGAATGCCAGAGACAGAAGAAATCAGAAAAGAGTACATTTTCTT
CATGGAGGGGATGGCTTCCATTCCTTTAAACTTTCCTGGAACAGCCTACAGAAGAGCTTTAC
AGTCAAGGTCCAGGATTCTGGCAATAATGGGGCAAAAGCTTGACGAAAGGATGCAGAAAATA
AAAGAAGGCTGTAAAGGACTGGAAGAAGAGGATCTTCTTGCCTCAGTTGCAAGAAATACTAA
CATAACAAGAGACCAGATTCTTGATTTGATGATCAGCATGCTTTTTGCTGGTCATGAAACTT
CTTCTGCCGCTATTTCTCTTGCCATTTATTTCCTGCAAGCTTCCCCGATGTTCTTAAAAAG
CTTCGAGAGGAGCACATAAAGATTGCAAAACAAAAGAAAGAAAGGGGCGAAACTGAATTGAA
CTGGGATGATTACAAGCAAATGGAATTCACAAACTGCGTTATTCATGAAACCCTAAGATTAG
GCAACATCGTTAAGTTTTTGCATCGGAAAACCATCAAAGATGTTCAATACAAAGGTTATGAA
ATTCCATGTGGGTGGGAAGTAGTGCCAATCATCTCAGCAGCACATTTGGATTCTTCTATCTT
TGACAACCCAAAAGTTATGAATCCTTCGAGGTGGGAGGCGATATTTTCAGCAGGAGCAAAGA
GCAATATAATGTCATTCAGCGGTGGACCTCGGTTATGTCCAGGAGCAGAGTTGGCGAAACTG
GAGATGGCTATTTTCTTCATCATCTTGTACAGAGGTTCGACTGGGAATTGGTGGAGAAGGA
TAACCCTGTATCATTCCCCTTCCTTGGATTTCCCAAGAAATTGCCTATCAAAATCACAGCTC
TTAAACATTGA
```

SEQ ID NO: 84, Allium cepa CYP90B nucleic acid sequence TC2113
MEIILVSTLIISLLIFLGFRSNGKTERKLLPTLPPGNLGGWPFIGDTIPFMTPHSSALLGTY
IDQNISKYGRIFRMNLLGKATIVSVDPDFNRYILQNEGRLFENSCPTSIKEILGKWSMLALA
GDIHREMRSIAVNFMNSVKLRTYFLKDIDIQAVNILDAWKVNSTFSAQDEGKKFAFNLMVKH
LMNMDPGMPETEEIRKEYIFFMEGMASIPLNFPGTAYRRALQSRSRILAIMGQKLDERMQKI
KEGCKGLEEEDLLASVARNTNITRDQILDLMISMLFAGHETSSAAISLAIYFLQASPDVLKK
LREEHIKIAKQKKERGETELNWDDYKQMEFTNCVIHETLRLGNIVKFLHRKTIKDVQYKGYE
IPCGWEVVPIISAAHLDSSIFDNPKVMNPSRWEAIFSAGAKSNIMSFSGGPRLCPGAELAKL
EMAIFLHHLVQRFDWELVEKDNPVSFPFLGFPKKLPIKITALKH

SEQ ID NO: 85, Zinnia elegans CYP90B nucleic acid sequence AB231155
ATGTGTTCAACAACCCTAAATATGTGTGACCTTGAGTTCTTCATCCTTGCATCTTGTCTTGT
CTTGGCTCTTTTTCTCATCTTGAAGCTTGTCAAAAGAAGAACAAACAATGGTTCGACTCGAA
ATCTTCCACCGGGCAACATGGGCTGGCCGTTCATCGGTGAAACCATCGGTTACCTCCAACCG
TATTCGGCTACAACCATCGGCAAGTTTATGGAACAACACATATCCAAGTATGGGAAGATATA
CAAATCTAGTTTGTTTGGTGAGCCAACAATAGTTTCTGCTGATCCAGGGTTGAATAAGTACA
TATTGCAAAATGAAGGGAGGTTATTTGAATGTAGTTATCCAAGAAGCATAGGGGGTATTCTT
GGCAAATGGTCCATGTTGGTTTTGGTTGGTGACATGCATAGAGACATGAGGCAAATTTCACT
CAACTTTTTGTCCAATGCAAGGCTTAAAACTCAACTAGTAAATGAAGTTGAGAAAAATACTT
TGTGGGTATTAGATTCTTGGAAAGAAAACTCACCTTTTTGTGCCCAAGAAGAAGCCAAGAAG
TTTACTTTTAATCTAATGGCAACACATATCATGAGTTTAGACCCGGGTGAACCGGAGACCGA
GCGATTGAAGAAAGAGTATGTAACTTTCATGAAAGGTGTGGTTTCTCCCCCTTTAAACTTCC
CTGGAACTGCATACTGGAAAGCTTTAAAGTCTCGAGCGACGATTCTTAAATTCATCGAAACA
AAAATGGAGGAGCGGATTAGGATGGACGAAGGAAACGGATTAGGGAAACTAGACAATGATCT
TCTTGGATGGTCTATGAAGAACTCAAATCTCACTAAAGAGCAAATACTCGATTTGGTATTGA
GTCTACTCTTTGCTGGTCACGAAACGTCTTCGGTTTCGATATCGTTAGCCGTTTACTTCCTT
GAAGCTTGTCCTACCGCGGTTCGTCAACTTAGAGAAGAACATGAAGAAATTGTGATGAAAAA
AAAGCTATTGGGTGAGAAGTATCTCACTTGGGATGACTACAAAAAGATGGAGTTTACTCAGT
GTGTGATCAATGAGACGCTAAGATTCGGGAATGTGGTGAGATTCCTCCACAGAAAGGCTATT
AAAGATGTGAGGTATAAAGGATATGACATTCCATGTGGTTGGAAAGTGCTGCCAGTGATTGC
AGCCGTGCATTTGGATCCTACACATTTTGACCAACCTTACCTTTTTGATCCATGGAGATGGC
AGAACGCAAGTGTCACGTCATCTACTTGTTCAACCCCGCCATCAGCAAGTAACTTCATGCCA
TTTGGTGGAGGGCCCCGCTTATGCACAGGGTCAGAGCTAGCGAAACTAGAGATGGCGATATT
TATCCACCATTTGGTCCTAAAATACGAGTGGGAATTGGTTGACTCAGATGAAGCATTCGCTT
ATCCATATCTCGACTTTCCAAAAGGTCTGCCAATCAAAATCCGTCACCGAAAACAATCATGT
TAG

SEQ ID NO: 86, Zinnia elegans CYP90B amino acid sequence
MCSTTLNMCDLEFFILASCLVLALFLILKLVKRRTNNGSTRNLPPGNMGWPFIGETIGYLQP
YSATTIGKFMEQHISKYGKIYKSSLFGEPTIVSADPGLNKYILQNEGRLFECSYPRSIGGIL
GKWSMLVLVGDMHRDMRQISLNFLSNARLKTQLVNEVEKNTLWVLDSWKENSPFCAQEEAKK
FTFNLMATHIMSLDPGEPETERLKKEYVTFMKGVVSPPLNFPGTAYWKALKSRATILKFIET
KMEERIRMDEGNGLGKLDNDLLGWSMKNSNLTKEQILDLVLSLLFAGHETSSVSISLAVYFL
EACPTAVRQLREEHEEIVMKKKLLGEKYLTWDDYKKMEFTQCVINETLRFGNVVRFLHRKAI
KDVRYKGYDIPCGWKVLPVIAAVHLDPTHFDQPYLFDPWRWQNASVTSSTCSTPPSASNFMP
FGGGPRLCTGSELAKLEMAIFIHHLVLKYEWELVDSDEAFAYPYLDFPKGLPIKIRHRKQSC

FIGURE 15 (continued)

SEQ ID NO: 87, Medicago trunculata CYP90B nucleic acid sequence AC147964.10
ATGTCTAACTCATACTTAACTTGCAGTTTTCTTTCTTCCATCTTTGTTCTTTCTTTGATTTT
CATTTTCATCAAAAGAAAGAAAACAAGGTATAATCTTCCACCTGGAAAAATGGGATGGCCCT
TTATAGGAGAAACCATTGGTTATTTGAAGCCTTACACTGCCACCACAATGGGAGAATTTATG
GAAAATCACATAGCAAGGTATGGGACAATTTACAAGTCAAATTTGTTTGGAGGGCCAGCTAT
TGTATCAGCAGATGCAGAATTGAATAGGTTCATATTACAAAATGATGGAAAATTGTTTGAGT
GTAGCTATCCAAAAAGCATTGGTGGAATACTTGGAAAATGGTCAATGTTGGTTTTAGTAGGT
GACATGCATAGGGAAATGAGGAATATATCACTAAACTTTATGAGCTATGCTAGGCTTAAAAC
ACATTTTTTGAAAGATATGGAGAAGCATACCCTTTTTGTTCTAAGCTCTTGGAAAGAAAATT
GTACATTTTCAGCTCAAGATGAAGCAAAAAGTTCACCTTCAATTTGATGGCCAAACAAATC
ATGAGTTTGGATCCAGGGAATCTTGAGACAGAACAGTTGAAAAAAGAGTATGTCTGTTTCAT
GAAAGGTGTTGTTTCTGCTCCTTTGAATTTGCCAGGAACTGCATACAGAAAGCATTAAAGT
CTAGGAACAATATATTGAAGTTCATAGAGGGGAAAATGGAAGAAAGGGTGAAGAGAAACCAA
GAAGGAAAAAAGGGATGGAGGAAAATGATCTTCTAAATTGGGTTTTAAAGCATTCAAATCT
TTCCACTGAGCAAATTCTTGACTTGATTCTAAGTTTACTTTTTGCTGGCCATGAAACTTCAT
CTGTGGCTATAGCTCTAGCTATTTACTTTTTGCCTAGTTGTCCTCAAGCTATACAACAATTA
AGGGAAGAGCATAGAGAAATAGCTAGATCCAAGAAGAAAGCAGGGGAGGTTGAATTAACTTG
GGATGATTATAAAAGAATGGAATTTACTCATTGTGTTGTGAATGAAACACTAAGGTTGGGTA
ATGTTGTGAGATTCCTTCACAGGAAGGCTATCAAAGATGTTCATTACAAAGGTTATGACATT
CCATGTGGATGGAAAGTCCTTCCGGTGATTTCAGCGGTACATTTGGATCCTTCAAATTTTGA
CCAACCTCAACACTTCAATCCTTGGAGATGGCAGATGAGCAATAACAACTTCATGCCATTTG
GAGGAGGACCAAGGCTATGTGCAGGATTAGAATTAGCCAAACTTGAAATGGCTGTTTTCATT
CACCATATCATCCTCAAATACAACTGGGACATGGTCGATGTTGATCAACCTATTGTATACCC
TTTTGTTGATTTTCCCAAAGGTTTGCCAATTAGAGTCCAAAGCCAAGCCACTCTTTAA

SEQ ID NO: 88, Medicago trunculata CYP90B amino acid sequence
MSNSYLTCSFLSSIFVLSLIFIFIKRKKTRYNLPPGKMGWPFIGETIGYLKPYTATTMGEFM
ENHIARYGTIYKSNLFGGPAIVSADAELNRFILQNDGKLFECSYPKSIGGILGKWSMLVLVG
DMHREMRNISLNFMSYARLKTHFLKDMEKHTLFVLSSWKENCTFSAQDEAKKFTFNLMAKQI
MSLDPGNLETEQLKKEYVCFMKGVVSAPLNLPGTAYRKALKSRNNILKFIEGKMEERVKRNQ
EGKKGMEENDLLNWVLKHSNLSTEQILDLILSLLFAGHETSSVAIALAIYFLPSCPQAIQQL
REEHREIARSKKKAGEVELTWDDYKRMEFTHCVVNETLRLGNVVRFLHRKAIKDVHYKGYDI
PCGWKVLPVISAVHLDPSNFDQPQHFNPWRWQQNNDGASGNSNIFLPFGGGPRLCAGLELAK
LEMAVFIHHIILKYNWDMVDVDQPIVYPFVDFPKGLPIRVQSQATL

SEQ ID NO: 89, Populus trichocarpa CYP90B nulceic acid sequence CK090847.1 CV280598.1 DT503533.1 compiled ESTs
ATGTCTCACTCAGAGCTTGTTGTCTTTCTCCTTCCATCGATTTTATCACTACTCTTGCTCTT
CATTCTCGTGCAAAGAAAGCAAGTAAGATTTAATCTCCCACCGGGCAACATGGGGTGGCCAT
TTCTTGGAGAAACCATTGGCTACCTGAAGCCTTACTCTGCTACTTCAATAGGAGAATTCATG
GAACAGCACATATCAAGGTATGGAAAGATTTACAAGTCCAATTTGTTTGGGGAGCCAACAAT
AGTATCCGCAGATGCTGGACTTAGCAGATTTATACTACAGAATGAGGGAAGATTATTTGAAT
GCAGCTATCCAAAAAGTATTGGTGGAATTCTTGGAAAATGGTCCATGATGGTTCTTGTTGGA
GACATGCATAGAGACATGAGGATTATATCTCTCAACTTTTTGAGCCATGCCAGGTTAAGAAC
TCATCTATTGAAAGAAGTGGAGAAGCAAACCCTGCTTGTTCTTAGCTCTTGGAAGGAGAATT
GTACATTTTCAGCTCAAGATGAAGCAAACAAGTTTACCTTCAATTGGATGGCAAAACATATC FIGURE 15 (continued)

```
ATGAGCTTGGATCCTGGAAAGACAGAGACTGAGCAGCTGAAAAAAGAGTATGTTACTTTCAT
GAAAGGAGTAGTTTCAGGTCCTATAAATTTTCCTGGAACCCCATATAGAAAAGCCTTGAAGT
CTCGATCAATCATCTTGAAATTTATAGAGCGAAAGATGGAGGAGAGAATTGGAGAAACGAAG
GGTGGAGTAGAAAACTTGGAAGACGATGATCTTCTTGGATGGGTCTTGAAGCATTCAAATCT
TTATACGGAGCAAATCCTTGAATTAATCTTAAGCTTGCTCTTTGCTGGCCACGAAACTTCTT
CTGTGTCCATAGCTCTAGCCATATCCTTCTTGCAAGCTTGTCCTGGTTCTATTCAACAGTTA
AAAGAAGAACATATTCAAATCTCCAGAGCCAAGAAACGGTCAGGAGAGACGGAATTGACCTG
GGATGATTACAAAAAAATGGAATTCACTCAATGCGTTATAAGCGAGACAGTGAGGCTTGGAA
ACGTAGTCAGGTTTGTTCACAGAAAAGCTCTAAAAGATGTTCGGTACAAAGGGTANGACATT
CCATGTGGATGGAAAGTGTTACCAGTAATCTCATCCGTCCATTTAGATTCAACTCTTTTCGA
CCAACCTCAACACTTCAATCCATGGAGATGGCAGCAGCACAACAATGCTCGTGGATCTTCTA
CTTGTTCGAGTGCGGCGGCGGCGGCGGCGGCGGTGAGTAGTAATCACTTCATGCCATTT
GGGGGAGGACCGCGACTCTGTGCAGGATCGGAATTGGCAAAACTTGAAATGGCAGTTTTCAT
TCACCATTTGGTTCTGAACTTCCATTGGGAATTGGTCGGTGCCGATCAAGCCTTTGCCTTTC
CTTTTGTTGATTTTCCTAAAGGCTTGCCAATAAGAGTCAAGCACCACACAGTCATATAA
```

SEQ ID NO: 90, Populus trichocarpa CYP90B amino acid sequence
MSHSELVVFLLPSILSLLLLFILVQRKQVRFNLPPGNMGWPFLGETIGYLKPYSATSIGEFM
EQHISRYGKIYKSNLFGEPTIVSADAGLSRFILQNEGRLFECSYPKSIGGILGKWSMMVLVG
DMHRDMRIISLNFLSHARLRTHLLKEVEKQTLLVLSSWKENCTFSAQDEANKFTFNWMAKHI
MSLDPGKTETEQLKKEYVTFMKGVVSGPINFPGTPYRKALKSRSIILKFIERKMEERIGETK
GGVENLEDDDLLGWVLKHSNLYTEQILELILSLLFAGHETSSVSIALAISFLQACPGSIQQL
KEEHIQISRAKKRSGETELTWDDYKKMEFTQCVISETVRLGNVVRFVHRKALKDVRYKGXDI
PCGWKVLPVISSVHLDSTLFDQPQHFNPWRWQQHNNARGSSTCSSAAAAAAAAVSSNHFMPF
GGGPRLCAGSELAKLEMAVFIHHLVLNFHWELVGADQAFAFPFVDFPKGLPIRVKHHTVI

SEQ ID NO: 91, Aquilegia formosa x Aquilegia pubescens CYP90B nucleic acid sequence (partial) DR940523.1 DR940522.1 compiled ESTs
```
ATGCCTGAGCTTGTGTTTTTCTTTTCATTAGCTCCAGCAATTTTAGCACTAATACTTCTCTT
GAAACTCTTCAAAAGGAAGAAAAAGTCATATAATCTTCCACCAGGAAACATGGGTTGGCCAT
ATCTAGGCGAAACTCTTGGTTATTTGAAGCCTTATTGTGCTATCACTACTGGAGATTTCATG
GAGCAACATATATCAAGGTATGGAAGATCTACAAGTCAAATTTATTTGGTTATCCTACAAT
AGTTTCAGTTGATCCTGAATTAAATCGATATGTATTACAAAACGAAGGAAGACTGTTTGAAT
GTAGTTATCCAAGTAGTTTAGGTGGGATTCTTGGCAAATGGTCAATGTTAGTTTTGGTTGGA
GACATGCATAAAAACATGAGGATGATCTCTGTCAACTTCATGAGCAGCGCAAGACTTCGAAC
ACATCTAATTCAAGATGTGGAGACTCAAGCCTTATTGGTGCTGAAATCTTGGCAGGTTGATA
AAAAGATTTTGGCCCAAGATGAAGCAAAGAAGTTTACCTTCAATTTAATTGTAAAAAATATA
ATGAGCATGGAACCTGGAACACCTGAAAGTGAGAAGCTTAGGAGGGAATACATTACATTCAT
GAAAGGAATCATTTCTGCGCCTTTGAATTTGCCTGGAACTGCATATAGAAGAGCCTTAAAGT
CTCGATCGAACATTCTGCAACTTATCGAGCATAACATGAATGAGAGACTCCAAAAGACTAAC
GGAGATGGTAAGAAAGTGGAAGATGATGATCTACTTGGATGGGTCTTGAAGCATTCAAATCT
TACCACTGAACAAATTCTTGATTTGATACTAAGTATGCTTTTCGCGGGTCATGAAACTTCCT
CAGTATCTATATCTCTAGCCATATACCTTTTGCAAGGATGCCTAAAAGCAGTTGAAGAGTTA
AGGGAAGAGCATATTAGAATTGCTAAAGCAAAAGAACAGGCAGGACAGAGATCTGGATTAAA
TTGGGAAGATTACAAACACATGGAATTCACTCAATGTGNNTTTCTTCATAGAAAAACTCTCA
AAGATGTTCAGTACAAAGGGTATGACATTCCATGTGGTTGGAAAGTTCTTCCAGTATTTGCA
```

FIGURE 15 (continued)

GCAGTTCATTTGGACCCTTTAAATTTCGACCAACCTCATGCTTTCAATCCATGGAGATGGCA
GAATGGGAAGACAAGCACGACGACTAACAACTTCATGCCGTTTGGTGGTGGATTACGGTTAT
GTGCTGGTTCAGAGCTAGCCAAGTTGGAAATGGCTATTTTCATTCACCATTTGGTCTTGAAT
TATGATTGGGATATAGCAGAACCAGATCAACCATTTGCCTACCCATTTGTTGAATTTCCAAA
AGGTCTACCAATTAAGGTCTATGACCATCAGTGCTTAACATGA

SEQ ID NO: 92, Aquilegia formosa x Aquilegia pubescens CYP90B
amino acid sequence (partial)
MPELVFFFSLAPAILALILLLKLFKRKKKSYNLPPGNMGWPYLGETLGYLKPYCAITTGDFM
EQHISRYGKIYKSNLFGYPTIVSVDPELNRYVLQNEGRLFECSYPSSLGGILGKWSMLVLVG
DMHKNMRMISVNFMSSARLRTHLIQDVETQALLVLKSWQVDKKILAQDEAKKFTFNLIVKNI
MSMEPGTPESEKLRREYITFMKGIISAPLNLPGTAYRRALKSRSNILQLIEHNMNERLQKTN
GDGKKVEDDDLLGWVLKHSNLTTEQILDLILSMLFAGHETSSVSISLAIYLLQGCLKAVEEL
REEHIRIAKAKEQAGQRSGLNWEDYKHMEFTQCXFLHRKTLKDVQYKGYDIPCGWKVLPVFA
AVHLDPLNFDQPHAFNPWRWQNGKTSTTTNNFMPFGGGLRLCAGSELAKLEMAIFIHHLVLN
YDWDIAEPDQPFAYPFVEFPKGLPIKVYDHQCLT SEQ ID NO: 93, Triticum aestivum 5' end CYP90B nucleic acid
sequence (partial)BQ620306.1
ATGGCCGCCATCATGGCCTCCATAACCAGCGAGCTCCTTTTCTTCCTCCCCTTCATCCTCCT
GGCCCTGCTCACCTTCTACACCAGCGCCGTGGCTAAATGCCATGGCCTCCACTGGTGGAGCG
GCCGGACGAAGAAGAGGCGGCCGAACCTGCCGCCCGGCGCCGTCGGCTGGCCCTTCATCGGC
GAGACCTTCGGGTACCTCCGCGCCCACCCGGCCACCTCCATCGGCCAGTTCATGGACCAGCA
CATCGCACGGTACGGGAAGATATACCGGTCGAGCCTGTTCGGGGACCGGACGGTGGTGTCGG
CGGACGCGGGGCTGAACCGGTACATCCTGCAGAACGAGGGGCGGCTGTTCGAGTGTAGCTAC
CCGCGGAGCATCGGCGGCATCCTTGGCAAATGGTCGATGCTGGTGCTCGTCGGCGACCCCCA
CCGCGAGATGCGCTTCATCTCCCTCAACTTCCTCAGCTCCGTCCGCCTCCGCGCCGTGCTCC
TCCCGGAGGTGGAGCGCCACACCCTCCTCGTCCTCCGCGACTGGCTGCCTTACTCCTCCTCC
TCCGTCTTCTCCGCGCAGCACGAAGCCAAGAAGTTCACGTTTAACCTGATGGCGAAGAACAT
CATGAGCATGGACCCCGGCGA SEQ ID NO: 94, Triticum aestivum N-terminal CYP90B amino acid
sequence (partial)
MAAIMASITSELLFFLPFILLALLTFYTSAVAKCHGLHWWSGRTKKRRPNLPPGAVGWPFIG
ETFGYLRAHPATSIGQFMDQHIARYGKIYRSSLFGDRTVVSADAGLNRYILQNEGRLFECSY
PRSIGGILGKWSMLVLVGDPHREMRFISLNFLSSVRLRAVLLPEVERHTLLVLRDWLPYSSS
SVFSAQHEAKKFTFNLMAKNIMSMDPG SEQ ID NO: 95, Triticum aestivum 3' CYP90B nucleic acid
sequence (partial) BQ619714.1 CA715360.1 compiled ESTs
GGAAGGCCCTCAAGTCGCGAGCCACCATACTTGGAGTAATAGAGAGGAAAATGGAGGAAAGG
CTTGAGAAAATGAATAAGGAGGCCTCGAGCATGGAAGAAGATGATCTTCTCGGGTGGGCGAT
GAAGCAGTCCAATCTTTCGAAAGAACAAATATTGGACCTCTTGCTGAGCTTGCTGTTTGCCG
GGCATGAGACATCGTCAATGGCGCTCGCCCTCGCCATCTTCTTCCTCGAAGGTTGCCCTAAA
GCCGTTGAAGAACTGCGGGAGGAGCATCTTGAGATTGCTAGGAGACAGAAGCTGAGAGGGGA
GTGCAAACTGAGCTGGAAGACTACAAAGAGATGGTTTTCACGCAATGCGTTATAAACGAGA
CCTTGCGGCTAGGCAACGTGGTCAGGTTCCTGCACCGGAAGGTCATTCGAGATGTGCACTAC

```
AATGGGTATGACATCCCGAGCGGATGGAAAATTCTGCCGGTGTTAGCGGCGGTGCATCTCGA
CTCGTCGCTGTACGAGGACCCCAGCAGCTTCAACCCTTGGAGATGGAAGGGCAACGCGTCCG
GCGTGGCGCAGAACAGTAACTTCATGCCCTACGGCGGCGGCACGAGGCTCTGCGCCGGGTCG
GAGCTCGCCAAGCTCGAGATGGCCATCTTCCTGCACCACCTGGTGCTCAACTTCCGGTGGGA
GCTCGCCGAGCCCGACCAGGCGTTCGTGTACCCGTTCGTCGACTTCCCCAAGGGCCTGCCCA
TCAGGGTCCATAGGATTGCACAGGAAGAAGAAGGAGAAGAGGAGTAA
```

SEQ ID NO: 96, Triticum aestivum C-terminal CYP90B amino acid sequence (partial)
```
KALKSRATILGVIERKMEERLEKMNKEASSMEEDDLLGWAMKQSNLSKEQILDLLLSLLFAG
HETSSMALALAIFFLEGCPKAVEELREEHLEIARRQKLRGECKLSWEDYKEMVFTQCVINET
LRLGNVVRFLHRKVIRDVHYNGYDIPSGWKILPVLAAVHLDSSLYEDPSSFNPWRWKGNASG
VAQNSNFMPYGGGTRLCAGSELAKLEMAIFLHHLVLNFRWELAEPDQAFVYPFVDFPKGLPI
RVHRIAQEEEGEE
```

SEQ ID NO: 97, Euphorbia esula CYP90B nucleic acid sequence (partial) DV141872.1
```
AGCATGGACCCTGGAAAACCAGAGACTGAAAAGCTCAAGAAAGAATATGTTACTTTCATGAA
AGGAGTTGTTTCTGCTCCTATTAATTTGCCTGGAACTGCTTATAGAAGGGCCTTACAGTCTC
GATCGACAATTTTGAAGTTCATAGAGGAGAAATGGAGGAAAGAAATGAAAAATTAAAAGAA
GGAAAAGCAGAGGAAGAAGAAGAAGATGATCTTCTAGGATGGGTTTTAAAGCATTCAAATCT
TTCAACTGAGCAAATTCTAGATTTGGTATTAAGTTTAATGTTTGCTGGCCATGAAACTTCTT
CAGTAGCAATTCTTNNAGCTATCTATTTTTTGCAAGATTCTCCTGCTGCTCTTCAACAGCTA
AGGGAAGAACATAAGGAAATTGAAAAAGCCAAGAAGCAGTCAGGAGAGAAGGGATTGAACTG
GGATGTTTACAAAAATATGGAATTCACTCAGTGTGTTATCAATGAAACACTAAGACTTGGAA
ATGTAGTCAGGTTCCTTCATAGGAAGACTATTAAACACGTTCAATACAAAGGATATGACATT
CCACGTGGATGGAAAGTGCTGCCAGTGATTGCAGCCGTGCATTTGGACAGTAGCCATTTTGA
GAAGCCTCAACACTTCAATCCATGGAGATGGTTGCACCAGAATAATGGGATACAAAATATGA
ATAATAATTTCATGCCATTTGGGGGAGGACCAAGATTATGTGCAGGATCAGAATTAGCAAAA
CTAGAAATGGCTATTTTTATTCATCATTTGGTCCTTAATTACCAG
```

SEQ ID NO: 98, Euphorbia esula CYP90B amino acid sequence (partial)
```
SMDPGKPETEKLKKEYVTFMKGVVSAPINLPGTAYRRALQSRSTILKFIEEKMEERNEKLKE
GKAEEEEDDLLGWVLKHSNLSTEQILDLVLSLMFAGHETSSVAILXAIYFLQDSPAALQQL
REEHKEIEKAKKQSGEKGLNWDVYKNMEFTQCVINETLRLGNVVRFLHRKTIKHVQYKGYDI
PRGWKVLPVIAAVHLDSSHFEKPQHFNPWRWLHQNNGIQNMNNNFMPFGGGPRLCAGSELAK
LEMAIFIHHLVLNYQ
```

SEQ ID NO: 99, Gossypium hirsutum CYP90B nucleic acid sequence (partial) CO125422 DT568185.1 compiled ESTs
```
ATGCCTGACTCAGAGCCTATTTTCTTGCTTCTTCCATCTATTTTATCTTTGATTCTGTTCTT
CATTCTCATCAAGAGAAAGCAAAGAAGGTATAATCTTCCACCAGGGAACATGGGGTGGCCTT
TTCTCGGCGAAACAATCGGTTACTTGAGGCCTTACTCTGCTACTTCAGTAGGTGAATTCATG
CACCAGCATATATCAAGGTATGGGAATATCTACAAATCGAATTTGTTTGGTGAGAAGACAAT
AGTGTCTGCAGATGCTGGGTTGAACAAGTTCATATTACAAAACGAAGGGAGATTATTCGAGT
GCAGTTACCCGAGAAGCATTGGTGGCATTCTTGGGAAATGGTCGATGCTGGTTTTGGTTGGG
```

FIGURE 15 (continued)

```
GATATGCATAGAGACATGAGGATTATATCACTCAACTTCTTGAGCAACGCCAGGCTGAGGAC
TCATCTTTTGAGAGAAGTGGAGAAACATACTTTGCTTGTTCTAAATACTTGGAAAGAGAAGT
GCATATTTTCAGCTCAGGATGAAGCAAAAAAGTTCACTTTCAATTTGATGGCAAAAAATATC
ATGAGCATGGACCCTGGACATCCAGAGACGGAGCAGCTAAAGAAAGAATATGTTACTTTCAT
GAAAGGAGTCGTTTCTGCTCCTTTAAATTTACCTGGAACTGCATACAGAAAAGCCTTACAAT
CTCGATCAACAATCCTGAAATTTATTGAAAAGAAATGGAAGTAAGGATAAGGAAAATGAAG
GAAGGAAAAGAAAACTCAGAGGAAGATGATCTTCTTGAATGGGTCTTAAAGCATTCTAATCT
TTCCACAGAGCAAATCCTTGACTTGATTTTGAGCTTGCTTTTTGCTGGACATGAGACTTCCT
CGGTAGCCATAACCTTAGCCATCTACTTCTTGCCAGGTTGTCCTTTGGCCATTCAACAGTTG
AGAGAGGAACACCTTGAAGTTGCAG
```

SEQ ID NO: 100, Gossypium hirsutum CYP90B amino acid sequence (partial)
MPDSEPIFLLLPSILSLILFFILIKRKQRRYNLPPGNMGWPFLGETIGYLRPYSATSVGEFM
HQHISRYGNIYKSNLFGEKTIVSADAGLNKFILQNEGRLFECSYPRSIGGILGKWSMLVLVG
DMHRDMRIISLNFLSNARLRTHLLREVEKHTLLVLNTWKEKCIFSAQDEAKKFTFNLMAKNI
MSMDPGHPETEQLKKEYVTFMKGVVSAPLNLPGTAYRKALQSRSTILKFIEKKMEVRIRKMK
EGKENSEEDDLLEWVLKHSNLSTEQILDLILSLLFAGHETSSVAITLAIYFLPGCPLAIQQL
RENTLKLQSQTNQRDXLNWDDTE

SEQ ID NO: 101, Lycopersicon esculentum CYP90B nucleic acid sequence (partial) BF050501 AW221826.1 BM409833 compiled ESTs
```
ATGGGTTGGCCTTTTCTTGGTGAAACTATTGGCTATTTGAGACCTTATTCAGCTACTACTAT
TGGAGATTTCATGCAAGATCATATCTCTAGGTATGGGAAAATTTTCAAGTCAAATTTGTTTG
GAGAGCCAACAATAGTTTCAGCAGATGCAGGGCTAAACAGATACATTCTGCAGAATGAAGGG
AGATTATTTGAGTGTAATTATCCAAGAAGTATAGGTGGGATACTTGGTAAATGGTCTATGTT
AGTTCAAGTTGGACAAATGCATAGAGATATGAGGATGATTTCTCTGAATTTTTTGAGCAATG
CTAGGCTAAGGAATCAACTTTTAAGTGAAGTTGAAAGCATACTTTGCTTGTTCTTGGCTCT
TGGAAACAGGATTCTGTTGTTTGTGCACAAGATGAAGCAAAGAAGTTAACATTCAACTTTAT
GGCAGAGCATATCATGAGTCTACAACCTGGAAATCCAGAGACAGAGAAGCTGAAAAAGAGT
ACATCACATTTATGAAAGGAGTGGTTTCTGCTCCATTGAATTTTCCAGGAACAGCTTACAGA
AAGGCCTTACAGTCTCGATCAACAATTCTTGGATTTATTGAGAGAAAAATGGAGGAGAGGCT
TAAGGAAATGAACAGAAACGAAAACGACCTTCTAGGTTGGGTTCTGAAGAATTCAAATCTCT
CAAAAGAGCAAATTCTTGATTTGCTACTGAGTTTGCTCTTTGCTGGCCATGAAACTTCATCA
GTAGCAATAGCTCTGTCTATTTTCTTACTCGAAAGCTGTCCTGCTGCTGTTCAACAATTAAC
AGAAGAGCACTTGGAGATTTCCCGGG
```

SEQ ID NO: 102, Lycopersicon esculentum CYP90B amino acid sequence (partial)
MGWPFLGETIGYLRPYSATTIGDFMQDHISRYGKIFKSNLFGEPTIVSADAGLNRYILQNEG
RLFECNYPRSIGGILGKWSMLVQVGQMHRDMRMISLNFLSNARLRNQLLSEVEKHTLLVLGS
WKQDSVVCAQDEAKKLTFNFMAEHIMSLQPGNPETEKLKKEYITFMKGVVSAPLNFPGTAYR
KALQSRSTILGFIERKMEERLKEMNRNENDLLGWVLKNSNLSKEQILDLLLSLLFAGHETSS
VAIALSIFLLESCPAAVQQLTEEHLEISR

FIGURE 15 (continued)

SEQ ID NO: 103, Solanum tuberosum 5' CYP90B nucleic acid sequence (partial) BQ114367 BQ045917 compiled ESTs
ATGTCTGACTTAGAGTTTTTTCTTTTTCTTGTTCCTCCAATCTTGGCAGTCCTTATTATTCT
TAATCTATTCAAAAGAAAACACAAATTTCAAAATCTTCCACCAGGGGATATGGGTTGGCCTT
TTCTTGGTGAAACTATTGGTTATTTGAGACCTTACTCAGTTACTACTATTGGAGATTTCATG
CAAGATCATATCTCAAGGTATGGGAAAATTTTCAAGTCAAATTTGTTTGGAGAGCCAACAAT
TGTTTCAGCAGATGCAGGGCTTAACAGATACATTCTGCAGAATGAAGGGAGATTATTTGAGT
GTAATTATCCAAGAAGTATAGGTGGGATACTTGGTAAATGGTCTATGTTGGTTCAAGTTGGA
CAAATGCATAGAGATATGAGGATGATTTCTCTGAATTTTTTGAGCAATGCTAGACTCAGGAA
TCAACTTTTAAGTGAAGTTGAAAAGCATACTGTGCTTGTTCTTGGCTCTTGGAAACAGGATT
CTGTTGTTTGTGCACAAGATGAAGCAAAGAAGTTTACATTCAACTTTATGGCAGAGCATATC
ATGAGTCTACAACCTGGAAATCCAGAGACAGAGAAGCTGAAGAAAGAGTACATCACATTTAT
GAAAGGAGTGGTTTCTGCTCCATTGAATTTTCCAGGAACAGCTTACAGAAAAGCCCTACAGT
CTCGATCAACAATTCTTGGAATTATTGAG

SEQ ID NO: 104, Solanum tuberosum N-terminal CYP90B amino acid sequence (partial)
MSDLEFFLFLVPPILAVLIILNLFKRKHKFQNLPPGDMGWPFLGETIGYLRPYSVTTIGDFM
QDHISRYGKIFKSNLFGEPTIVSADAGLNRYILQNEGRLFECNYPRSIGGILGKWSMLVQVG
QMHRDMRMISLNFLSNARLRNQLLSEVEKHTVLVLGSWKQDSVVCAQDEAKKFTFNFMAEHI
MSLQPGNPETEKLKKEYITFMKGVVSAPLNFPGTAYRKALQSRSTILGIIE

SEQ ID NO: 105, Solanum tuberosum C-terminal CYP90B nucleic acid sequence (partial) BQ114368.1 EST
ggaaagctgtgaaagatgttcgatacaaaggttatgacattccatgtggatggaaagtattg
ccggtgatttcagcagcgcatttagatccttcacttttgaccgacctcacgactttgatcc
ttggagatggcagaatgcagaagagtcgccttcaggtaaaggaggaagcacaggcacaagca
gcacaacaaaaagtagtaataatttcatgccatttgggggaggtccacgtctatgtgcagga
tctgaactggccaaacttgagatggccattttcattcactatcttgttcttaattttcactg
gaaattagctgcacctgatcaggcttttgcctatccttacgtagattttcccaatgccctac
caatcactatccaacatcgatcgtcaaataaattaaaccaccacacttactacctctaa

SEQ ID NO: 106, Solanum tuberosum C-terminal CYP90B amino acid sequence (partial)
KAVKDVRYKGYDIPCGWKVLPVISAAHLDPSLFDRPHDFDPWRWQNAEESPSGKGGSTGTSS
TTKSSNNFMPFGGGPRLCAGSELAKLEMAIFIHYLVLNFHWKLAAPDQAFAYPYVDFPNALP
ITIQHRSSNKLNHHTYYL

SEQ ID NO: 107, prm06540
GGGGACAAGTTTGTACAAAAAAGCAGGCTTAAACAATGGCCGCCATGATGGC

SEQ ID NO: 108, prm06520
GGGGACCACTTTGTACAAGAAAGCTGGGTTTACTCCTGCTCATCATCC

SEQ ID NO: 109, Oryza sativa endosperm specific promoter
CTTCTACATCGGCTTAGGTGTAGCAACACGACTTTATTATTATTATTATTATTATTATT
ATTTTACAAAAATATAAAATAGATCAGTCCCTCACCACAAGTAGAGCAAGTTGGTGAGTTAT

FIGURE 15 (continued)

TGTAAAGTTCTACAAAGCTAATTTAAAAGTTATTGCATTAACTTATTTCATATTACAAACAA
GAGTGTCAATGGAACAATGAAAACCATATGACATACTATAATTTTGTTTTTATTATTGAAAT
TATATAATTCAAAGAGAATAAATCCACATAGCCGTAAAGTTCTACATGTGGTGCATTACCAA
AATATATATAGCTTACAAAACATGACAAGCTTAGTTTGAAAAATTGCAATCCTTATCACATT
GACACATAAAGTGAGTGATGAGTCATAATATTATTTTCTTTGCTACCCATCATGTATATATG
ATAGCCACAAAGTTACTTTGATGATGATATCAAAGAACATTTTTAGGTGCACCTAACAGAAT
ATCCAAATAATATGACTCACTTAGATCATAATAGAGCATCAAGTAAAACTAACACTCTAAAG
CAACCGATGGGAAAGCATCTATAAATAGACAAGCACAATGAAAATCCTCATCATCCTTCACC
ACAATTCAAATATTATAGTTGAAGCATAGTAGTA

SEQ ID NO: 110, Oryza sativa embryo/aleurone specific promoter
GGTCAGCCAATACATTGATCCGTTGCCAATCATGCAAAGTATTTTGGCTGTGGCCGAGTGCC
GGAATTGATAATTGTGTTCTGACTAAATTAAATGACCAGAAGTCGCTATCTTCCAATGTATC
CGAAACCTGGATTAAACAATCCTGTTCTGTTCTCTAGCCCCTCCTGCATGGCCGGATTGTTT
TTTTGACATGTTTTCTTGACTGAGGCCTGTTTGTTCTAAACTTTTTCTTCAAACTTTTAACT
TTTTCATCACATCAGAACTTTTCTACACATATAAACTTTTAACTTTTCCGTCACATCGTTCC
AATTTCAATCAAACTTTCAATTTTGGCGTGAACTAAACACACCCTGAGTCTTTTATTGCTCC
TCCGTACGGGTTGGCTGGTTGAGAATAGGTATTTTCAGAGAGAAAATCTAGATATTGGGAGG
AACTTGGCATGAATGGCCACTATATTTAGAGCAATTCTACGGTCCTTGAGGAGGTACCATGA
GGTACCAAAATTTTAGTGTAAATTTTAGTATCTCATTATAACTAGGTATTATGAGGTACCAA
ATTTACAATAGAAAAATAGTACTTCATGGTACTTTCTTAAGTACCGTAAAATTGCTCCTAT
ATTTAAGGGGATGTTTATATCTATCCATATCCATAATTTGATTTGATAAGAAAAAATGTGA
GCACACCAAGCATGTCCATGACCTTGCACTCTTGGCTCACTCGTCAACTGTGAAGAACCTCA
AAAATGCTCAATATAGCTACAGGTGCCTGAAAAAATAACTTTAAAGTTTTGAACATCGATTT
CACTAAACAACAATTATTATCTCCCTCTGAAAGATGATAGTTTAGAACTCTAGAATCATTGT
CGGCGGAGAAAGTAAATTATTTTCCCCAAATTTCCAGCTATGAAAAAACCCTCACCAAACAC
CATCAAACAAGAGTTCACCAAACCGCCCATGCGGCCATGCTGTCACGCAACGCACCGCATTG
CCTGATGGCCGCTCGATGCATGCATGCTTCCCCGTGCACATATCCGACAGACGCGCCGTGTC
AGCGAGCTCCTCGACCGACCTGTGTAGCCCATGCAAGCATCCACCCCCGCCACGTACACCCC
CTCCTCCTCCCTACGTGTCACCGCTCTCTCCACCTATATATGCCCACCTGGCCCCTCTCCTC
CCATCTCCACTTCACCCGATCGCTTCTTCTTCTTCTTCGTTGCATTCATCTTGCTAGC

SEQ ID NO: 111, Glycine max Glyma_CYP90B nucleic acid sequence contig of BF324723.1, AW759817.1, DX407703, CL885557.1, BG726252.1
ATGTCTGACTCACTCTTAACTTTCTATTCTCTTTCAGCCATTCTTGCTCTTCTCCCAATCTT
CATCTTCATTCTCATCAAAAGAAAGCAAAGCAAACCCAGGCTCAACCTTCCCCCAGGTAACA
TGGGTTGGCCATTTCTTGGTGAAACCATTGGCTATTTGAAGCCTTATTCTGCCACCACAGTA
GGGGAATTCATGGAGCAACACATAGCAAGGTATGGTACAATTTACAAGTCAAAACTGTTTGC
GGGGCCAGCAATAGTGTCAGCAGATGCAGGACTCAACAGGTTCATTCTACAAAACGAAGGGA
AATTGTTCGAGTGCAGCTATCCTAGAAGCATCGGTGGAATACTAGGAAAATGGTCCATGTTG
GTCTTAGTTGGTGACATGCATAGAGACATGCGGGTTATATCACTCAACTTTCTAAGCCACGC
CAGGCTCAGAACACACCTCTTGAAAGAGGTGGAGAAGCAATCCCTCTTGGTTCTGAACTCTT
GGAGCCAAAATTCCATATTCTCAGCCCAAGATGAAGCTAAGAAGTTCACCTTCAATTTAATG
GCTAAGCATATCATGAGCATGGATCCTGGGGATATCGAGACAGAGCAACTAAAGAAAGAGTA
CGTCACTTTCATGAAGGGGTGGTTTCCGCGCCATTGAATTTACCTGGAACTGCATACCGAA
AGGCATTGAAGTCTCGGTCCATTATACTAAAGTTCATAGAGGGGAAAATGGAAGAGAGAGTT
AGAAGAATCCAAGAGGGGAATGAGAGTTTGGAGGAAGATGATCTTCTAAATTGGGTTTTGAA

FIGURE 15 (continued)

GAATTCAAATCTTTCAACCGAGCAAATTCTTGACTTGATTCTCAGCTTGCTCTTCGCTGGCC
ATGAAACTTCGTCGGTAGCCATAGCTCTAGCCATTTACTTCTTACCCGGTTGTCCTCAAGCT
ATACAACAGTTAAAGGAAGAACACAGAGAAATTGCCAGAGCCAAAAAGCAAGCAGGGGAAGT
TGAACTCACTTGGGATGACTACAAACGAATGGAATTTACTCATTGTGTAANNTTGGGAAATG
TTGTGAGGTTTCTCCACAGGAAGGCTGTGAAAGATGTTAACTATAAAGGTTATGACATTCCA
TGTGGGTGGAAAGTCCTCCCGGTGATTGCAGCCGTGCATCTGGATCCTTCACTTTTTGACCA
ACCTCAACACTTCAATCCATGGAGATGGCAGAACAATGGCAGTCATGGAAGTTGTCCAAGCA
AGAACACAGCAAACAACAACTTTCTTCCGTTCGGAGGAGGACCACGATTATGTGCAGGATCA
GAGTTAGCTAAGCTTGAAATGGCTGTTTTCATTCACCATCTCATTCTCAACTACCATTGGGA
ATTGGCTGATACCGATCAAGCTTTTGCCTACCCTTTTGTCGACTTCCCCAAAGGCCTACCCG
TTAGAGTCCAAGCCCATTCTTTACTTTGA

SEQ ID NO: 112, Glycine max Glyma_CYP90B translated polypeptide sequence
MSDSLLTFYSLSAILALLPIFIFILIKRKQSKPRLNLPPGNMGWPFLGETIGYLKPYSATTV
GEFMEQHIARYGTIYKSKLFAGPAIVSADAGLNRFILQNEGKLFECSYPRSIGGILGKWSML
VLVGDMHRDMRVISLNFLSHARLRTHLLKEVEKQSLLVLNSWSQNSIFSAQDEAKKFTFNLM
AKHIMSMDPGDIETEQLKKEYVTFMKGVVSAPLNLPGTAYRKALKSRSIILKFIEGKMEERV
RRIQEGNESLEEDDLLNWVLKNSNLSTEQILDLILSLLFAGHETSSVAIALAIYFLPGCPQA
IQQLKEEHREIARAKKQAGEVELTWDDYKRMEFTHCVSGMIINELWRSTCLFFYFMYSNCYY
YYLMNMLVVSNIIWDDEAXXVGLGNVVRFLHRKAVKDVNYKGYDIPCGWKVLPVIAAVHLDP
SLFDQPQHFNPWRWQNNGSHGSCPSKNTANNNFLPFGGGPRLCAGSELAKLEMAVFIHHLIL
NYHWELADTDQAFAYPFVDFPKGLPVRVQAHSLL

SEQ ID NO: 113, Gossypium hirsutum Goshi_CYP90B nucleic acid sequence
ATGCCTGACTCAGAGCCTATTTTCTTGCTTCTACCATCTATTTTATCTTTGATTCTGTTCTT
CATTCTCATCAAGAGAAAGCAAAGAAGGTATAATCTTCCACCAGGGAACATGGGGTGGCCTT
TTCTCGGCGAAACAATCGGTTACTTGAGGCCTTACTCTGCTACTTCAGTAGGTGAATTCATG
CACCAGCATATATCAAGGTATGGGAATATCTACAAATCGAATTTGTTTGGTGAGAAGACAAT
AGTGTCTGCAGATGCTGGGTTGAACAAGTTCATATTACAAAACGAAGGGAGATTATTCGAGT
GCAGTTACCCGAGAAGCATTGGTGGCATTCTTGGGAAATGGTCGATGCTGGTTTTGGTTGGG
GATATGCATAGAGACATGAGGATTATATCACTCAACTTCTTGAGCAACGCCAGGCTGAGGAC
TCATCTTTTGAGAGAAGTGGAGAAACATACTTTGCTTGTTCTAAATACTTGGAAAGAGAAGT
GCATATTTTCAGCTCAGGATGAAGCAAAAAGTTCACTTTCAATTTGGTGGCAAAAAATATC
ATGAGCATGGACCCTGGACATCCAGAGACGGAGCAGCTAAAGAAAGAATATGTTACTTTCAT
GAAAGGAGTCGTTTCTGCTCCTTTAAATTTACCTGGAACTGCATACAGAAAAGCCTTACAAT
CTCGATCAACAATCCTGAAATTTATTGAAAAGAAATGGAAGTAAGGATAAGGAAAATGAAG
GAAGGAAAAGAAAACTCAGAGGAAGATGATCTTCTTGAATGGGTCTTAAAGCATTCTAATCT
TTCCACAGAGCAAATCCTTGACTTGATTTTGAGCTTGCTTTTTGCTGGACATGAGACCTCCT
CGGTAGCCATAACCTTAGCCATCTACTTCTTGCCAGGTTGTCCTTTGGCCATTCAACAGTTG
AGAGAAGAACACCTTGAAGTTGCCAGAGCCAAGAACCAATCAGGAGAGACTGAACTCAACTG
GGATGATTACAAGAAAATGGAGTTCACTCAATGTGTTATTAACGAGACACTTAGGCTTGGTA
ATGTCGTCAGATTTCTCCACAGAAAGCTCTCAAAGATATTAGATATAAAGGTTATGATATT
CCATGTGGGTGGAAAGTGCTTCCAGTGATTGCAGCAGTGCACTTGGATCCCTGTCTTTTTGA
CCACCCTCAACTCTTCAATCCATGGCGATGGCAGCAAAATAATGGGAGTCGAGGGCGGGGA
CGGCAACGTCATCAGCGAGCAGCAGCAATTACTTCATGCCATTCGGGGAGGACCACGGCTA
TGTGCAGGAACAGAGCTGGCTAAACTGGAAATGGCGGTGTTCATCCACCATTTGGTCCTCAA
CTACCAGTGGGAGTTAGCCGATACGGATGAAGCCTTTGCCTTCCCTTTTGTCGACTTCCCTA
AAGGCCTACCCATCAGAGTCTTCAAATCTTAA

FIGURE 15 (continued)

SEQ ID NO: 114, Gossypium hirsutum Goshi_CYP90B
MPDSEPIFLLLPSILSLILFFILIKRKQRRYNLPPGNMGWPFLGETIGYLRPYSATSVGEFM
HQHISRYGNIYKSNLFGEKTIVSADAGLNKFILQNEGRLFECSYPRSIGGILGKWSMLVLVG
DMHRDMRIISLNFLSNARLRTHLLREVEKHTLLVLNTWKEKCIFSAQDEAKKFTFNLVAKNI
MSMDPGHPETEQLKKEYVTFMKGVVSAPLNLPGTAYRKALQSRSTILKFIEKKMEVRIRKMK
EGKENSEEDDLLEWVLKHSNLSTEQILDLILSLLFAGHETSSVAITLAIYFLPGCPLAIQQL
REEHLEVARAKNQSGETELNWDDYKKMEFTQCVINETLRLGNVVRFLHRKALKDIRYKGYDI
PCGWKVLPVIAAVHLDPCLFDHPQLFNPWRWQQNNGSRGAGTATSSASSSNYFMPFGGGPRL
CAGTELAKLEMAVFIHHLVLNYQWELADTDEAFAFPFVDFPKGLPIRVFKS

SEQ ID NO: 115, Zea mays Zeama_CYP90B_1 nucleic acid sequence contig of EE156535.1 CA452603.1 EE156534.1 CG333964.1
ATGGGCGCCATGATGGCCTCCATAACCAGCGAGCTCCTCTTCTTCCTTCCCTTCATCCTGCT
GGCCCTCCTCGCCTTGTACACCACCACCGTCGCCAAATGCCACGGCACCCACCCGTGGCGCC
GTCAGAAGAAGAAGCGGCCCAACCTGCCCCCGGGCGCCCGCGGATGGCCCTTGGTCGGCGAA
ACTTTCGGCTACCTCCGCGCCCACCCGGCCACCTCCGTGGGCCGCTTCATGGAGCGGCATGT
CGCACGGTACGGGAAGATATACCGGTCGAGCCTGTTCGGGGAGCGGACGGTGGTGTCGGCGG
ACGCGGGGCTGAACCGCTACATCCTGCAGAACGAGGGGCGGCTGTTCGAGTGCAGCTACCCG
CGCAGCATCGGCGGCATCCTGGGCAAGTGGTCCATGCTGGTGCTCGTGGGCGACGCGCACCG
CGAGATGCGCGCTATCTCGCTCAACTTCCTCAGCTCCGTCCGCCTCCGCGCCGTGCTGCTCC
CCGAGGTGGAGCGCCACACCCTGCTGGTCCTCCGCTCGTGGCCGCCCTCCGACGGCACCTTC
TCCGCCCAGCACGAAGCCAAGAAGTTCACGTTTAACCTGATGGCGAAGAACATAATGAGCAT
GGACCCCGGCGAGGAGGAGACGGAGCGGCTGCGGCTGGAGTACATCACCTTCATGAAGGGCG
TCGTGTCAGCGCCGCTCAACTTCCCGGGCACGGCCTACTGGAAGGCGCTCAAGTCACGCGCG
TCCATACTTGGAGTGATAGAGAGGAAGATGGAGGACAGGCTTGAGAAGATGAGCAGGGAGAA
GTCAAGCGTGGAGGAGGACGACCTTCTTGGATGGGCCCTGAAGCAATCCAACCTGTCCAAGG
AACAGATCCTGGACCTCTTGCTGAGCCTGCTCTTCGCGGGGCACGAGACTTCGTCCATGGCG
CTCGCCCTCGCCATCTTCTTCCTCGAAGGGTGCCCTAAGGCCGTGCAAGAACTCCGGGAGGA
GCATCTCCTGATTGCTAGGAGACAAAGGCTAAGAGGGGCGTCTAAATTGAGCTGGGAAGACT
ACAAGGAAATGGTTTTCACGCAGTGTGTTATAAACGAGACATTGCGGCTCGGCAACGTGGTC
AGGTTCCTGCACCGGAAGGTCATCCGAGATGTACACTACAATGGGTACGACATACCGCGGGG
GTGGAAAATCCTGCCGGTTCTAGCGGCGGTGCACCTGGACTCGTCGCTGTACGAGGACCCCA
GCCGGTTCAACCCTTGGAGATGGAAGAGCAACAACGCGCCAAGCAGCTTCATGCCGTACGGC
GGCGGGCCGCGGCTGTGCGCCGGGTCGGAGCTGGCCAAGCTGGAGATGGCCATCTTCCTGCA
CCACCTGGTGCTCAACTTCCGGTGGGAGCTGGCGGAGCCGGACCAGGCCTTCGTTTACCCTT
TCGTCGACTTCCCCAAGGGCCTCCCGATCAGGGTCCAGCGGGTCGCCGACGACCAAGGCCAT
CGTAGCGTTTTGACCGAGAGCACAAGAGGCTGA

SEQ ID NO: 116, Zea mays Zeama_CYP90B_1 translated polypeptide
MGAMMASITSELLFFLPFILLALLALYTTTVAKCHGTHPWRRQKKKRPNLPPGARGWPLVGE
TFGYLRAHPATSVGRFMERHVARYGKIYRSSLFGERTVVSADAGLNRYILQNEGRLFECSYP
RSIGGILGKWSMLVLVGDAHREMRAISLNFLSSVRLRAVLLPEVERHTLLVLRSWPPSDGTF
SAQHEAKKFTFNLMAKNIMSMDPGEEETERLRLEYITFMKGVVSAPLNFPGTAYWKALKSRA
SILGVIERKMEDRLEKMSREKSSVEEDDLLGWALKQSNLSKEQILDLLLSLLFAGHETSSMA
LALAIFFLEGCPKAVQELREEHLLIARRQRLRGASKLSWEDYKEMVFTQCVINETLRLGNVV
RFLHRKVIRDVHYNGYDIPRGWKILPVLAAVHLDSSLYEDPSRFNPWRWKSNNAPSSFMPYG
GGPRLCAGSELAKLEMAIFLHHLVLNFRWELAEPDQAFVYPFVDFPKGLPIRVQRVADDQGH
RSVLTESTRG

FIGURE 15 (continued)

SEQ ID NO: 117, Zea mays Zeama_CYP90B_2 nucleic acid sequence
ZM58195574-58721845
ATGGGCGCCATGATGGCCTCCATAACCAGCGAGCTCCTCTTCTTCCTTCCCTTCATCCTGCT
GGCCCTCCTCGCCTTGTACACCACCACCGTCGCCAAATGCCACGGCACCCACCAGTGGCGCC
GTCAGAAGAAGAAGCGGCCCAACCTGCCCCGGGCGCCCGCGGATGGCCCTTGGTCGGCGAG
ACTTTCGGCTACCTCCGCGCCCACCCGGCCACCTCCGTGGGCCGCTTCATGGAGCGGCATGT
CGCACGGTACGGGAAGATATACCGGTCGAGCCTGTTCGGGGAGCGGACGGTGGTGTCGGCGG
ACGCGGGGCTGAACCGGTACATCCTGCAGAACGAGGGCGGCTGTTCGAGTGCAGCTACCCG
CGCAGCATCGGCGGCATCCTGGGCAAGTGGTCCATGCTGGTGCTCGTGGGCGACGCGCACCG
CGAGATGCGCGCTATCTCGCTCAACTTCCTCAGCTCCGTCCGCCTCCGCGCCGTGCTGCTCC
CCGAGGTGGAGCGCCACACCCTGCTGGTCCTCCGCTCCTGGCCGCCTCCGACCGGCACCTTC
TCCGCCCAGCACGAAGCCAAGAAGTTCACGTTTAACCTGATGGCGAAGAACATAATGAGCAT
GGACCCCGGCGAGGAGGAGACGGAGCGGCTGCGGCTGGAGTACATCACCTTCATGAAGGGCG
TCGTGTCAGCGCCGCTCAACTTCCCGGGCACGGCCTACTGGAAGGCGCTCAAGTCGCGCGCG
TCCATACTTGGAGTGATAGAGAGGAAGATGGAGGACAGGCTTGAGAAGATGAGCAGGGAGAA
GTCAAGCGTGGAGGAGGACGACCTTCTTGGATGGGCCCTGAAGCAATCCAACCTGTCCAAGG
AACAGATCCTGGACCTCTTGCTGAGCCTGCTCTTCGCGGGCACGAGACTTCGTCCATGGCG
CTCGCCCTCGCCATCTTCTTCCTCGAAGGGTGCCCTAAGGCCGTGCAAGAACTCCGGGAGGA
GCATCTCCTGATTGCTAGGAGACAAAGGCTAAGGGGGCGTCCAAATTGAGCTGGGAAGACT
ACAAGGAAATGGTTTTCACGCAGTGTGTTATAAACGAGACATTGCGGCTCGGCAACGTGGTC
AGGTTCCTGCACCGGAAGGTCATCCGAGATGTACACTACAATGGGTACGACATACCGCGGGG
GTGGAAAATCCTGCCGGTTCTAGCGGCGGTGCACCTGGACTCGTCGCTGTACGAGGATCCCA
GCCGGTTCAACCCTTGGAGATGGAAGGTCAGTGCCCTGCCCCCTCCCCTCGCAAAAGGCACA
AGCCAAGGGACAAGCAAGAGGTTTACACCGTTCGGTGGTGGCCCCCGGCTCTGCCCAGGATC
AGAGCTCGCTAAAGTGGAGACTGCTTTCTTCCTCCATCACCTTGTCCTCAATTATAGATGGA
GAATTGATGGCGATGACATTCCAATGGCATACCCGTATGTGGAGTTTCAGAGAGGTCTGCCA
ATAGAAATCGAGCCAACGTCCCCTGAATTTGACTGTCCTGGAGCTACAGCCATCAGTTATCA
CACCAGAGAGAAATGA SEQ ID NO: 118, Zea mays Zeama_CYP90B_2 translated polypeptide
MGAMMASITSELLFFLPFILLALLALYTTTVAKCHGTHQWRRQKKKRPNLPPGARGWPLVGE
TFGYLRAHPATSVGRFMERHVARYGKIYRSSLFGERTVVSADAGLNRYILQNEGRLFECSYP
RSIGGILGKWSMLVLVGDAHREMRAISLNFLSSVRLRAVLLPEVERHTLLVLRSWPPPTGTF
SAQHEAKKFTFNLMAKNIMSMDPGEEETERLRLEYITFMKGVVSAPLNFPGTAYWKALKSRA
SILGVIERKMEDRLEKMSREKSSVEEDDLLGWALKQSNLSKEQILDLLLSLLFAGHETSSMA
LALAIFFLEGCPKAVQELREEHLLIARRQRLGASKLSWEDYKEMVFTQCVINETLRLGNVV
RFLHRKVIRDVHYNGYDIPRGWKILPVLAAVHLDSSLYEDPSRFNPWRWKVSALPPPLAKGT
SQGTSKRFTPFGGPRLCPGSELAKVETAFFLHHLVLNYRWRIDGDDIPMAYPYVEFQRGLP
IEIEPTSPEFDCPGATAISYHTREK SEQ ID NO: 119, Brassica rapa Brara_CYP90B partial nucleic acid sequence contig of ED531940.1, DU985218.1, AJ859443.1
ATGTTCGAAACAGAGCATACTCTCGTGCCTCTTCTTCTTCTCCCATCACTTCTATCTCTTCT
CCTCTTCTTGATTCTCTTGAAGAGACGAAGTCGACACAGTTTCAATCTCCCTCCTGGAAAAT
CTGGATGGCCATTTCTAGGCGAAACCATCGGATATCTCAAACCTTACTCTGCCAAAACTCTC
GGTTACTTCATGCAACAACATATCTCCAAGTATGGGAAGATATATAGATCGAATTTGTTTGG
AGAACCAACGATCGTATCAGCTGATGCAGGACTCAACAGGTTCATATTACAAAACGAAGGAA FIGURE 15 (continued)

```
GACTCTTTGAATGTAGTTATCCTCGAAGTATTGGTGGGATTCTTGGGAAATGGTCGATGCTT
GTTCTTGTTGGAGACATGCATAGAGACATGAGAAGTATCTCGCTAAACTTTCTAAGTCACGC
TCGTCTCAGAACGATTCTTCTTAAGGACGTTGAGAGGCATACTTTGTTCGTTCTTAATTCTT
GGCAACAACATTCTGTTTTCTCTGCTCAAGATGAGGCCAAAAAGTTTACGTTTAATCTAATG
GCGAAGCATATAATGAGTATGGATCCTGGAGAAGAAGAGACAGAGCAGTTAAAGAAAGAGTA
TGTGACTTTCATGAAAGGGGTTGTTTCTGCTCCTCTCAATCTCCCAGGAACTGCTTATCGTA
AAGCTCTCCAGCAGTCACGAGGGACGATATTGAAGTTTATTGAGAAGAAAATGGAAGAGAGA
AAATCAGAGATTCAAGAAGAAGACGAAGAAGATGAAGCAGAGATTAGTAGAAGTGATCATTA
TGAGAGAAAACATAGAGCAGATGATGATCTTTTGGGATGGGTTCTAAAACATTCCAATCTTT
CGACTGAGCAAATTCTCGATCTTATTCTCAGTTTATTATTTGCCGGACATGAGACATCATCT
GTAGCCATCGCTCTCGCTATCTACTTTTTAGCGGGCNNNTTGAAGGAAGAGCATCTTGAAAT
CGCGAGGGTGAAGAAGGAACTTGGAGAGTCAGAATTGAATTGGGATGATTACAAGACAATGG
ACTTTACTCATAGTGTTATAAATGAGACTCTTCGACTAGGAAATGTAGTAAGGTTTTTGCAT
CGTAAAGCACTCAAAAACGTTCGGTATAAAGGATACGATATCCCAAGTGGGTGGAAAGTGTT
ACCAGTGATCTCAGCCGTACATTTGGATAACTCCCGTTACGACGAACCTAATCTCTTTAATC
CTTGGAGATGGCAACAG

SEQ ID NO: 120, Brassica rapa Brara_CYP90B partial translated polypeptide
MFETEHTLVPLLLLPSLLSLLLFLILLKRRSRHSFNLPPGKSGWPFLGETIGYLKPYSAKTL
GYFMQQHISKYGKIYRSNLFGEPTIVSADAGLNRFILQNEGRLFECSYPRSIGGILGKWSML
VLVGDMHRDMRSISLNFLSHARLRTILLKDVERHTLFVLNSWQQHSVFSAQDEAKKFTFNLM
AKHIMSMDPGEEETEQLKKEYVTFMKGVVSAPLNLPGTAYRKALQQSRGTILKFIEKKMEER
KSEIQEEDEEDEAEISRSDHYERKHRADDDLLGWVLKHSNLSTEQILDLILSLLFAGHETSS
VAIALAIYFLAGXLKEEHLEIARVKKELGESELNWDDYKTMDFTHSVINETLRLGNVVRFLH
RKALKNVRYKGYDIPSGWKVLPVISAVHLDNSRYDEPNLFNPWRWQQ

SEQ ID NO: 121, Hordeum vulgare Horvu_CYP90B partial nucleic acid sequence BJ474344.1, AV835480
ATGGCCGCCATGATGGCATCCATAACCAGCGAGCTCCTTTTCTTCCTCCCCTTCATCCTCCT
GGCCCTGCTCACCTTCTACACCAGCAGCGTGGCCAAATGCCATGGCCTCCACCGGTGGAGCG
GCCGGACGAAGAAGAAGCGGCCGAATCTGCCGCCCGGCGCCGCCGGCTGGCCTTTCGTCGGC
GAGACCTTCGGGTACCTCCGCGCCCACCCGGCCACCTCCATCGGCCAGTTCATGAACCAGCA
CATCGCACGGTACGGGAAGATATACCGGTCGAGCCTGTTCGGGGAGCGGACGGTGGTGTCGG
CGGACGCGGGGCTGAACCGGTACATCCTGCAGAACGAGGGCGGCTGTTCGAGTGCAGCTAC
CCGCGGAGCATCGGCGGCATCCTGGGCAAATGGTCCATGCTGGTGCTCGTGGGCGACCCCCA
CCGCGAGATGCGCTCCATCTCCCTCAACTTCCTCAGCTCCCTCCGCCTCCGCGCCGTGCTCC
TCCCGGAGGTGGAGCGCCACACCCTCCTCGTCCTCCGCGACTGGCTGCCTTCCTCCTCCTCC
GCCGTCTTCTCCGCCCAGCACGAAGCCAAGAAGTTCACGTTTAACCTGATGGCGAAGAACAT
CATGAGCATGGACCCCGGCGAGGAGGAGACGGAGCGGCTGAGGCTCGAGTACATCACCTTCA
TGAAGGGGGTGGTGTCCGCGCCCCTCAACTTCCCCGGGACGGCCTACTGGAAGGCCCTCAAG
TCTCGAGCCACCATACTTGGGGTAATAGAGAGGAAAATGGAGGATAGGCTCGAGAAAATGAA
CAAGGAGGCCTCGAGCATGAAGAAGATATCTCTCGGGGGCG
```

SEQ ID NO: 122, Hordeum vulgare Horvu_CYP90B partial translated polypeptide
MAAMMASITSELLFFLPFILLALLTFYTSSVAKCHGLHRWSGRTKKKRPNLPPGAAGWPFVG
ETFGYLRAHPATSIGQFMNQHIARYGKIYRSSLFGERTVVSADAGLNRYILQNEGRLFECSY
PRSIGGILGKWSMLVLVGDPHREMRSISLNFLSSLRLRAVLLPEVERHTLLVLRDWLPSSSS
AVFSAQHEAKKFTFNLMAKNIMSMDPGEEETERLRLEYITFMKGVVSAPLNFPGTAYWKALK
SRATILGVIERKMEDRLEKMNKEASSMKKISLGG SEQ ID NO: 123, LOTUS JAPONICUS LOTJA_CYP90B PARTIAL NUCLEIC ACID SEQUENCE AP007781.1
ATGTCTGACTCATACCTCACTTTCTGTTTTCTTTCTTCCATTCTTGCTCTCACTGTAATCAT
CATTTTCATGAAAAGAAAGAAGGCAAGGCTTAACCTTCCCCCTGGAAAAATGGGATGGCCCT
TTCTTGGGGAAACCATTGGGTACTTGAAGCCATACTCTGCTACCACAGTAGGAGATTTTATG
GAAAAGCACATAGCAAGGTATGGTACAATTTACAAGTCAAAATTGTTTGGTGAGCCTGCAAT
AGTTTCTGCAGATGCAGAGTTGAACAGGTTCATATTACAGAACGAAGGGAAGCTGTTTGAGT
GCAGCTATCCAAGAAGCATTGGAGGAATACTTGGAAAATGGTCCATGTTGGTCTTAGTTGGG
GACATGCATAGGGACATGAGAAACATTTCACTGAACTTTCTGAGCCTTGCTAGGCTCAAAAC
ACATCTATTGAAAGAAGTGGAGAAGCACTCTCTTCTAGTTCTAGGCTCTTGGAAAGAAAATT
GTACATTCTCAGCTCAAGATGAAGCAAAGAAGTTCACATTCAATTTGATGGCGAAACATATC
ATGAGCTTGGATCCTGGGAATCTAGAGACAGAACAGCTGAAGAAAGAGTATGTCTCTTTCAT
GAATGGTGTGGTGTCTGCACCTTTGAATTTTCCCGGAACTGCATACAGAAAAGCATTAAAGT
CTAGGTCCACCATACTGAAGTTCATAGAGGGAAAAATGGAAGAAAGGATCAAAAGAAACCAA
AATTTGGAGGAAGATCTTCTAAACTGGGTTGTGATGCATTCAAATCTTTCAACTGAGCAAAT
TCTTGACCTGGTTCTGAGCTTGCTCTTTGCAGGCCATGAAACTTCATCTGTGGCTATAGCTT
TAGCTATTTACTTTTTGCCAGGTTGTCCTAAAGCTATACAACAATTAAGGGAAGAACATAGA
GAAATAGCCAGGTCCAAGAAGCAAGCAGGGGAGGTTGAATTAACTTGGGATGATTACAAAAG
AATGGAGTTTACTCAATGTGTAGTTGTGAATGAAACACTGAGGTTGGGAAATGTTGTGAGGT
TCCTTCACAGGAAGGCTCTGAAAGATGTTCGGTACAAAGGTTATGACATTCCACGTGGGTGG
AAAGTCCTCCCTGTGATTTCAGCTATGCATCTGGATCCTGCACTTTTTTACCAACCTCAACA
CTTCAATCCATGGAGATGGAAG SEQ ID NO: 124, Lotus japonicus Lotja_CYP90B partial translated polypeptide
MSDSYLTFCFLSSILALTVIIIFMKRKKARLNLPPGKMGWPFLGETIGYLKPYSATTVGDFM
EKHIARYGTIYKSKLFGEPAIVSADAELNRFILQNEGKLFECSYPRSIGGILGKWSMLVLVG
DMHRDMRNISLNFLSLARLKTHLLKEVEKHSLLVLGSWKENCTFSAQDEAKKFTFNLMAKHI
MSLDPGNLETEQLKKEYVSFMNGVVSAPLNFPGTAYRKALKSRSTILKFIEGKMEERIKRNQ
NLEEDLLNWVVMHSNLSTEQILDLVLSLLFAGHETSSVAIALAIYFLPGCPKAIQQLREEHR
EIARSKKQAGEVELTWDDYKRMEFTQCVVVNETLRLGNVVRFLHRKALKDVRYKGYDIPRGW
KVLPVISAMHLDPALFYQPQHFNPWRWK SEQ ID NO: 125, Malus domestica Maldo_CYP90B partial nucleic acid sequence EG631390
AGAGACATGAGGATGATATCTCTCAACTTCTTGAGCCATGCCAGACTCAGAACCCATCTGAT
GAGAGAAGTTGAAAAGCACACTCTTCTTGTTTGGGGAGTTGGAAGGAAAACTCTGTTTTTT
CAGCTCAGGATGAAGCTAAGAAGTTCACGTTCAACTTGATGGCCAAACATATCATGAGCTTG
GATCCTGGAAAACCAGAGACTGAGCAGCTGAAGAAATTGTATGTTACTTTCATGAAAGGTGT FIGURE 15 (continued)

```
GGTTTCTCCTCCTCTGAATTTACCAGGAACAGCTTACAGAAGAGCCTTACAGTCAAGATCAA
CGATTCTGAAGTTTATAGAGTGCAAAATGAAAGAAAGATTGATGGAGGGAACCGAAAACATT
GGGGAAGATGATCTGCTTGGATGGGTTCTGAAGAATTCAAATCTTTCAAAGGAGCAAATTCT
TGACTTAATATTGAGCTTGCTCTTTGCTGGCCATGAAACTTCATCAGTGTCTATAGCCTTAG
CAATTTACTTTTTACCAAGCTGCCCTAATGCAATTCTGCAGTTAAGGGAAGAACACAGTGAA
ATTGCCAAAGCCAAGAAACTGGCAGGCGAGACAGAGTTGAATTGGGAGGACTACAAGAAAAT
GGAGTTCACCGAATGTGTAATCTGTGAGACACTTCGGCTTGGGAATGTGGTGAGATTTTTAC
ACAGAAAGGCTCTGAAGGATGTTCGGTACAAAGGGTATGACATTCCATCTGGGTGGAAAGTG
CTTCCGGTGATTGCAGCCGTGCATTTGGATCCTTTACTTTTTGACCACCCGCAACACTTCAA
TCCATGGAGATGGCAGCAGAATAACAACCACCACCACCGTGGATCATCGTCGTCATCATCAT
GCTACACGAGCATGACAAGTCACAACTTTATGCCATTTGGGGGAGGACCACGACTTTGCGCC
GGTTCAGAATTGGCCAAACTTGAAATGGCCGTGTTCATCCACCACCTTGTCCTCAACTTCCA
CTGGGAGTTAGCCGATCCTTTCGACAAACCTTTTGCTTTCCCCTTCGTCGATTTCCAAAATG
GCCTACCAATCACAGCCCACCGCTACGTACCAAACTAA
```

SEQ ID NO: 126, Malus domestica Maldo_CYP90B partial translated polypeptide
RDMRMISLNFLSHARLRTHLMREVEKHTLLVLGSWKENSVFSAQDEAKKFTFNLMAKHIMSL
DPGKPETEQLKKLYVTFMKGVVSPPLNLPGTAYRRALQSRSTILKFIECKMKERLMEGTENI
GEDDLLGWVLKNSNLSKEQILDLILSLLFAGHETSSVSIALAIYFLPSCPNAILQLREEHSE
IAKAKKLAGETELNWEDYKKMEFTECVICETLRLGNVVRFLHRKALKDVRYKGYDIPSGWKV
LPVIAAVHLDPLLFDHPQHFNPWRWQQNNNHHHRGSSSSSSCYTSMTSHNFMPFGGGPRLCA
GSELAKLEMAVFIHHLVLNFHWELADPFDKPFAFPFVDFQNGLPITAHRYVPN

SEQ ID NO: 127, Vitis vinifera Vitvi_CYP90B partial nucleic acid sequence contig of DT013384, DT011548
```
AGACTTCATGGAGCAACACATATCAAGGTTCGGAGAAATCTACAAGTCCAATCTGTTTGGCG
AGCCAACCATAGTCTCAGCGGATTCTGGGCTGAACAGATTCATACTACAGAACGAAGGAAAA
TTGTTTGAATGCAGCTATCCCAGAAGCATAGGTGGAATTCTTGGGAAATGGTCCATGCTGGT
TTTAGTTGGAGACATGCATAGAGACATGAGAACCATCTCCCTCAACTTCTTGAGCCATGGCA
GGCTTAGGACTCATCTCCTACCAGAGGTGGTGAAGCACACTTTGCTTGTTCTAAGCTCTTGG
AAGGAGAATTGTACATTTTCTGCTCAAGATGAAGCTAAGAAGTTTACCTTCAATCTGATGGC
AAAACATATCATGAGCTTGGATCCCGGAAAGCCGGAGACTGAGCAGCTTAAGAAAGAGTATG
TTACTTTCATGAAAGGAGTGGTATCTGCTCCTTTGAATTTCCCTGGAACTGCATACAGAAAA
GCCCTACAGTCTCGGTCCACCATCTTAAAATTTATCGAGCTGAAGATGGAAGAGAGGATTCA
GAAACTGAGGGGAGGAGGGTTTGAGAATATGGAGGATGACGATCTTCTTGGATGGGTGCTGA
AGCATTCCAACCTTTCAACTGAGCAAATCCTGGACTTGGTACTGAGCTTGCTCTTTGCTGGC
CATGAAACTTCATCAGTGGCAATAGCTTTAGCTATCTACTTCTTGGAAGGCTGTCCCAACGC
CGTT
```

SEQ ID NO: 128, Vitis vinifera Vitvi_CYP90B partial translated polypeptide
DFMEQHISRFGEIYKSNLFGEPTIVSADSGLNRFILQNEGKLFECSYPRSIGGILGKWSMLV
LVGDMHRDMRTISLNFLSHGRLRTHLLPEVVKHTLLVLSSWKENCTFSAQDEAKKFTFNLMA
KHIMSLDPGKPETEQLKKEYVTFMKGVVSAPLNFPGTAYRKALQSRSTILKFIELKMEERIQ
KLRGGGFENMEDDDLLGWVLKHSNLSTEQILDLVLSLLFAGHETSSVAIALAIYFLEGCPNA FIGURE 15 (continued)

Arath_CDC27B Hobbit
full length

```
                          1                                                  50
        Arath_CDC27A   (1) ------MMENLLANCVQKNLNHFMFTNAIFLCELLLAQFPSE-VNLQLLA
   Arath_CDC27B_Hobbit (1) -------MEAMLVDCVNNSLRHFVYKNAIFMCERLCAEFPSE-VNLQLLA
         Soltu_CDC27   (1) -------METLLAESVQNSLGQFMYHNAIFMCERLCAEFPTE-TNMQLLA
         Orysa_CDC27   (1) -------METLMVDRVHGSLRLFMHRNAVFLCERLCAQFPAE-VNVQLLA
    Sacof_CDC27 partial (1) -------METLMVDRVHSSLRLFMHRNAVFLCERLCAQFPSE-TNVQLLA
          Aspni_BIMA   (1) MTPSTSHISSQLRQLIYYHLDNNLARNALFLAGRLHAYEPRTSEASYLLA
         Schpo_nuc2+   (1) --------MTDRLKCLIWYCIDNQNYDNSIFYSERLHAIEDSN-ESLYLLA
         Homsa_CDC27   (1) ----MTVLQEPVQAAIWQALNHYAYRDAVFLAERLYAEVHSE-EALFLLA
           Consensus   (1)         METLL D V  SL  FMYRNAIFLCERLCA FPSE  NLQLLA
                                                      PD011373
                         51                                                  100
        Arath_CDC27A  (44) RCYLSNSQAYSAYYILKGS----KTPQSRYLFAFSCFKLDLLGEAEAALL
   Arath_CDC27B_Hobbit (43) TSYLQNNQAYSAYHLLKGT----QMAQSRYLFALSCFQMDLLNEAESALC
         Soltu_CDC27  (43) GCYLHNQQAYAAYHLLKGT----SMAQSRYLFALSCFQMDLLTEAETALC
         Orysa_CDC27  (43) TCYLHNNQPYAAYHILKGK----KLPESRYLFAMSCFRMNLLREAEEALC
    Sacof_CDC27 partial (43) TCYLHNNQPYAAYHILKGK----KLPESRYLFATSCFRMNLLREAEETLC
          Aspni_BIMA  (51) LCYLQNGQVKAAWETSKHFGSRGAHLGCSYVYAQACLDLGKYTDGINALE
         Schpo_nuc2+  (43) YSHFLN-LDYNIVYDLLDRVI--SHVPCTYLFARTSLILGRYKQGISAVE
         Homsa_CDC27  (46) TCYYRSGKAYKAYRLLKGHSC--TTPQCKYLLAKCCVDLSKLAEGEQILS
           Consensus  (51) TCYL NNQAYAAYHILKG       LPQSRYLFA SCF L LL EAE ALC
                                                PD011373
                                                                TRP
                         101                                                 150
        Arath_CDC27A  (90) PC-------EDYAE--------EVPGQAAGHYLLGLIYRYSGRKNCSIQQF
   Arath_CDC27B_Hobbit (89) P--------VNEP--------GAEIPNQAAGHYLLGLIYKYTDRRKNAAQQF
         Soltu_CDC27  (89) P--------PNEP--------TAEVPNQAAGHYLLGLIYRYTDRRNSSIQHF
         Orysa_CDC27  (89) P--------VNEP--------NIEVPSQATGHYLLGVIYRYTGRVEAAAEQF
    Sacof_CDC27 partial (89) P--------VNEP--------NMEVPSQATGHYLLGVIYRCTGRISAAAEQF
          Aspni_BIMA (101) RSKGQWTSRNHWNKHSETRRQHLPDAAAVLCLQGKLWQAHKEHNKAVECY
         Schpo_nuc2+  (90) ACRS-NWRSIQPNINDSISSRGHPDASCMLDVLGTMYKKAGFLKKATDCF
         Homsa_CDC27  (94) GG------VFNKQKSHDDIVTEFGDSACFTLSLLGHVYCKTDRLAKGSECY
           Consensus (101) P          NEP         EVP  AAGHYLLGLIYRYTGRL  AAEQF
                                                PD011373

151                                                 200
        Arath_CDC27A (126) RMALSFDPLQWEAYGELCSLGAAEEASTVFGNVASQRLQKTCVEQRISFS
   Arath_CDC27B_Hobbit (125) KQSLTIDPLIWAAYEELCILGAAEEATAVFGETAALSIQKQYMQQLSTSL
         Soltu_CDC27 (125) NQALLLDPLIWAAYEELCILGAAEEAAAVFGEASLLCIQKQHIDQGNQSQ
         Orysa_CDC27 (125) VQALTLDPLIWAAYEELCILGVAEDANECFSEATALRLQQELTSTSNVEK
    Sacof_CDC27 partial (125) TQALTLDPLIWAAYEELCILGIAEDTDECFSESTALRLQQEHTSTATLVK
          Aspni_BIMA (151) AAALKLNPFMWDAFLNLCETGVDLRVSNIYKMSPELYSMVSSAALEDVES
         Schpo_nuc2+ (139) VEAVSINPYNFSAFQNLTAIGVPLDANNVFVIPPYLTAMKGFEKS-----
         Homsa_CDC27 (139) QKSLSLNPFIWSPFESLCEIGEKPDPDQTFKFTSLQNFSNCLPNSCTTQV
           Consensus (151) QALSLDPLIWAAYEELCILGVAEDA  VF ESSAL LQK    S
                                                PD011373

201                                                 250
        Arath_CDC27A (176) EGATIDQ----ITDSDKALKDTGLSQTEHIPGENQ------QDLKIMQOP
   Arath_CDC27B_Hobbit (175) GLNTYNEERNSTSTKNTSSEDYSPRQSKHTQSHGL------KDISGNFH-
         Soltu_CDC27 (175) NLQASTDDQN-VASTNIVSGDISPMQSKHTHSHNL------REMSGNYNG
         Orysa_CDC27 (175) -SNFVNENRFLSSNVSASFGDS-PKQIKQLHANTT------AEVSGYPHV
    Sacof_CDC27 partial (175) -SNFANENRVLSSRVSANLGDISPKQIKQLHANNI------AEVSGYPHV
          Aspni_BIMA (201) QVLPPDGPLQTQVNPNPSLDPFTAGTTRSDSTSTHGSSALWEKLNGSTVS
         Schpo_nuc2+ (184) ------Q---TNATASVPEPSFLKKSKESSSSSNK------FSVSESIAN
         Homsa_CDC27 (189) PNHSLSHRQPETVLTETPQDTIELNRLNLESSNSK------YSLNTDSSV
           Consensus (201)    N  E   SS    S  D SPKQSK   S N        ELSG
```

FIGURE 17

```
                              251                                              300
          Arath_CDC27A  (216) GDIP-------PNTDRQLSTNGWDLNTPSPVLLQVMDALPPLLLKNMRRP
    Arath_CDC27B_Hobbit (218) -----------SHGVNGGVSNMSFYNTPSPVAAQLSGIAPPPLFRNFQPA
            Soltu_CDC27 (218) A-AA-------IQNLGGVSTNMSFYNTPSPMASQLSGVVPPPVCRNFQQN
            Orysa_CDC27 (217) KSTA-------LHMQNGAPSNLSQFDTPSPTSTQVSGIAPPPLFRNMHAY
     Sacof_CDC27 partial (218) RPTA-------LHVQNSSTSNVAQFDTPSPTAAQTSSIMPPPLFRNVHA-
             Aspni_BIMA (251) VASSGTGPHLPREGMETPGGQSSESDDPRVTNGNGTDVFEPPLAPAKKNR
            Schpo_nuc2+ (219) SYS----------NSS--ISAFTKWFDRVDASELPGSEKERHQSLKLQSQ
            Homsa_CDC27 (233) SYIDSAVISPDTVPLGTGTSILSKQVQNKPKTGRSLLGGPAALSPLTPSF
              Consensus (251)    SA         L   SSNLS F TPSP AAQLS I PPPL RNM A 301                                              350
          Arath_CDC27A  (259) ----------------------------------AVEGSLMSVHGVRVRRRNFF
    Arath_CDC27B_Hobbit (257) VANPNSLITDSSP--KSTVNSTLQAPRRKFVDEGKLRKISGRLFSDSG--
            Soltu_CDC27 (260) GTNASVAGADNSP--RATVNSTIQAPRRKFVDEGKLRKISGRLFSDSG--
            Orysa_CDC27 (260) QN--T-AGGNAPS--KPKVNAPNLTLRRKYIDEAGLKKVSGRLFNQSSDS
     Sacof_CDC27 partial (261) ---------------------------------IQIQIPGVWREWYRLF------
             Aspni_BIMA (301) TIQTIGGDHPMDPPPKMRPTGIRPRTRTKFESDEGHTERDAGMGHRLG--
            Schpo_nuc2+ (257) --------------------------------SQTSKNLLAFNDAQKADS----
            Homsa_CDC27 (283) GILPLETPSPGDG--SYLQNYTNTPPVIDVPSTGAPSKKSVARIGQTG--
              Consensus (301)                K  N       R KFI EGGL KISGRLF  SG 351                                              400
          Arath_CDC27A  (279) SEELSAEAQEESGRRRSARIAARKKNPMSQSFGK------DSHWLHLSPS
    Arath_CDC27B_Hobbit (303) -PRRSSRLSADSGANINSSVATVSGN-VNNASKYLG-----GSKLSSLAL
            Soltu_CDC27 (306) -PRRNSRLAGESTGNTSNVSGASGNGTIHSSKYYG-----SSKLSSMTL
            Orysa_CDC27 (305) VPRRSARLSRDTTINSNSNISQFGGNGTDHSSGKLRVNSSTPSKLCSTAL
     Sacof_CDC27 partial (277) -----------------------VR--EIAS------KLVHTIKMVLTTI
             Aspni_BIMA (349) ---DRKRTVSGQVAHPSVPHSTDQGVGQRRSVRLFNQIKPSTNKISSTAL
            Schpo_nuc2+ (275) --------------------------NN--R------DTSLKSHFVEP
            Homsa_CDC27 (329) --TKSVFSQSGNSREVTPILAQTQSSGPQTSTTPQVLSPTITSPPNALPR
              Consensus (351)      RSAR    DS   S  IA   GNG  SSK         SSKL ST L 401                                              450
          Arath_CDC27A  (323) ESNYAPSLSSMIGKCRIQSSKEVIPDTVTLNDPATTSGQSVSDIGSSVDD
    Arath_CDC27B_Hobbit (346) RSVTLRKGHSWANENMDEGVR----GEPFDDSRP--NTASTTGSMASNDQ
            Soltu_CDC27 (350) RSMTSRKAQSWATENYGEGTR----NDISNDSRLNMTMSHPSGDARPLEQ
            Orysa_CDC27 (355) RSVQVRKGKPQATENFDEG----DYHFDMDDSVTSTSSSTSIVDGRYPEQ
     Sacof_CDC27 partial (296) RSVQVRKGKPRATENFDEGSRYEVIDEMWTDNISGTSSSVSTADGRSFEQ
             Aspni_BIMA (396) GVKEGREVKKVRTTGNKARTTTSSNVGRVVSGNN-RRHAGEIHDGDSKEY
            Schpo_nuc2+ (289) RTQALRPGARLTYKLREAR----------------SSKRGESTPQSFREE
            Homsa_CDC27 (377) RSSRLFTSDSSTTKENSKKLKMKFPPKIPNRKTKSKTNKGGITQPNINDS
              Consensus (401) RSV LRKG S ATEN DEGSR        I D     TS S  S DG S EQ 451                                              500
          Arath_CDC27A  (373) EEKSNPSESSPDRFSLIS-------------GISEVLSLLKILGDGHRHL
    Arath_CDC27B_Hobbit (390) EDETMSIGGIAMSSQTITIG-----------VSEILNLLRTLGEGCRLS
            Soltu_CDC27 (396) ERPRTSASGVNVSSTSIPLS-----------ASEILALFRFLGEGYRLS
            Orysa_CDC27 (401) EK----SERVLSQDSKLAIG-----------IRELMALLRTLGEGYRLS
     Sacof_CDC27 partial (346) DK----AERILLQDSKLALG-----------IREILGLVRTLGEGCRLS
             Aspni_BIMA (445) RGTSSTSNGSQNASSKLAISER----TKSVEALAWILDLFFKIASGYFCL
            Schpo_nuc2+ (323) DN-------------------------------NLMELLKLFGKGVYLL
            Homsa_CDC27 (427) LEITKLDSSIISEGKISTITPQIQAFNLQKAAAAGLMSLLREMGKGYLAL
              Consensus (451) E    S  S    I    S  IAI            ISEILALLR LGEGYRLS
```

FIGURE 17 (continued)

```
                                                                    TPR
                              501                                       550
    Arath_CDC27A       (410) HMYKCQEALLAYQKLSQKQYNTHWVLMQVGKAYFELQDYFNADSSFTLAH
    Arath_CDC27B_Hobbit (428) YMYRCQEALDTYMKLPHKHYNTGWVLSQVGKAYFELIDYLEAEKAFRLAR
         Soltu_CDC27   (434) CLYRCQDALDVYNKLPHKHYHTGWVLSQIGRAYFEMVDYLEADHAFGLAR
         Orysa_CDC27   (435) CLFKCQEALEVYRKLPEAQFNTGWVLCQVGKTYFELVNYLEADHFFELAH
    Sacof_CDC27 partial (380) CLFKCHEALEVYRRLPETHXSTGWSICQVGKAYFELVDYLEADRYFELAH
          Aspni_BIMA   (491) SRYKCSDAIQIFSSLSQGQRETPWVLAQIGRAYYEQAMYTEAEKYFVRVK
          Schpo_nuc2+  (341) AQYKLREALNCFQSLPIEQQNTPFVLAKLGITYFELVDYEKSEEVFQKLR
         Homsa_CDC27   (477) CSYNCKEAINILSHLPSHHYNTGWVLCQIGRAYFELSEYMQAERIFSEVR
            Consensus  (501) CLYKCQEALDVY KLP  QYNTGWVLAQVGKAYFELVDYLEADK F LAR 551                                       600
    Arath_CDC27A       (460) QKYPYALEGMDTYSTVLYHLKEEMRLGYLAQELISVDRLSPESWCAVGNC
    Arath_CDC27B_Hobbit (478) LASPYQLEGMDIYSTVLYHLKEDMKLSYLAQELISTDRLAPQSWCAMGNC
         Soltu_CDC27   (484) LASPYSLEGMDVYSTVLFHLKEDMKLSYLAQVLVSTDRLAPQSWCAMGNC
         Orysa_CDC27   (485) RLSPCTLEGMDIYSTVLYHLNEEMRLSYLAQDLVSIDRLSPQAWCAVGNC
    Sacof_CDC27 partial (430) RLSPCTLDGMDIYSTVLYHLNEEMRLSYLAQELISIDRLSPQAWCAVGNC
          Aspni_BIMA   (541) AMAPSHLEDMEIYSTVLWHLKNDVELAYLAHELMDVDRLSPEAWCAVGNS
          Schpo_nuc2+  (391) DLSPSHVKDMEVFSTALWHLQKSVPLSYLAHETLETNPYSPESWCILANW
         Homsa_CDC27   (527) RIENYHVEGMEIYSTTLWHLQKDVALSVLSKDLTDMDKNSPEAWCAAGNC
            Consensus  (551)  LSPY LEGMDIYSTVLYHLKEDMRLSYLAQELISIDRLSPQAWCAVGNC TPR
                              601                                       650
    Arath_CDC27A       (510) YSLRKDHDTALKMFQRAIQLNERFTYAHTLCGHEFAALEEFEDAERCYRK
    Arath_CDC27B_Hobbit (528) YSLQKDHETALKNFLRAVQLNPRFAYAHTLCGHEYTTLEDFENGMKSYQN
         Soltu_CDC27   (534) YSLQKDHETALKNFQRAVQLNPRFAYGHTLCGHEYVALEDFENAIKSYQS
         Orysa_CDC27   (535) FALRKDHETALKNFQRAVQLDSRVAYAHTLCGHEYSALEDYENSIKLYRS
    Sacof_CDC27 partial (480) FALRKDHETALKNFQRSVQLDSRFAYAHTLCGHEYSALEDYENSIKFYRC
          Aspni_BIMA   (591) FSHQRDHDQALKCFKRATQLDPHFYGFTLQGHEY------ADS------
          Schpo_nuc2+  (441) FSLQREHSQALKCINRAIQLDPTFYAYTLQGHEHSANEEYEKSKTSFRK
         Homsa_CDC27   (577) FSLQREHDIAIKFFQRAIQVDPNYAYAYTLLGHEFVLTEELDKALACFRN
            Consensus  (601) FSLQKDHETALKNFQRAVQLDPRFAYAHTLCGHEYSALEDFENSIK YR TPR                TPR
                              651                                       700
    Arath_CDC27A       (560) ALGIDTRHYNAWYGLGMTYLRQEKFEFAQHQFQLALQINPRSSVIMCYYG
    Arath_CDC27B_Hobbit (578) ALRVDTRHYNAWYGLGMIYLRQEKLEFSEHHFRMAFLINPSSSVIMSYLG
         Soltu_CDC27   (584) ALRVDARHYNAWYGLGMIYLRQEKFEFSEHHFRMALGINPQSSVIMSYLG
         Orysa_CDC27   (585) ALQVDERHYNAWYGLGVVYLRQEKFEFAEHHFRRAFQINPCSSVLMCYLG
    Sacof_CDC27 partial (530) ALQVDERHYNAWYGLGVVYLRQEKXEFAEHHFRRAFQINPRSSVLMCYLG
          Aspni_BIMA   (629) ------RHYNAWYGLGTVYDKMGKLDFAEQHFRNAAKINPSNAVLICCIG
          Schpo_nuc2+  (491) AIRVNVRHYNAWYGLGMVYLKTGRNDQADFHFQRAAEINPNNSVLITCIG
         Homsa_CDC27   (627) AIRVNPRHYNAWYGLGMIYYKQEKFSLAEMHFQKALDINPQSSVLLCHIG
            Consensus  (651) ALRVD RHYNAWYGLGMVYLRQEKFEFAEHHFRRA  INP SSVLMCYLG
```

FIGURE 17 (continued)

```
                                        TPR                        TPR
                              ┌─────────────────────────┬─────────────────────────┐
                              │701                                               750│
          Arath_CDC27   (610) │IALHESKRNDEALMMMEKAVLTDAKN PLPKYYKAHILTSLGDYHKAQKVI│
     Arath_CDC27B_Hobbit (628)│TSLHALKRSEEALEIMEQAIVADRKN PLPMYQKANILVCLERLDEALEVI│
           Soltu_CDC27  (634) │TALHALKKNEEALEVMELAIVADKKN PLPMYQKANILVSTESFDAALEVI│
           Orysa_CDC27  (635) │MALHALKRNEEALEMMENAIFADKKN PLPKYQKALILLGLQKYPDALDEI│
      Sacof_CDC27 partial (580)│MALHSLKRKEEALEMMEKAIAADKKN PLPKYQKALILLGLQKYQEALDEI│
             Aspni_BIMA  (673) │LVLEKMNNPKSALIQYNRACTLAPHS VLARFRKARALMKLQDLKSALTEI│
             Schpo_nuc2+ (541) │MIYERCKDYKKALDFYDRACKLDEKS SLARFKKAKVLILLHDHDKALVEI│
            Homsa_CDC27  (677) │VVQHALKKSEKALDTLNKAIVIDPKN PLCKFHRASVLFANEKYKSALQEI│
               Consensus (701) │MALHALKR EEALEMMEKAIVADKKN PLPKYQKA ILL L KY  ALDEI│
                              └─────────────────────────┴─────────────────────────┘

TPR                        TPR
                              ┌─────────────────────────┬─────────────────────────┐
                              │751                                               800│
          Arath_CDC27   (660) │EELKECAPQE SVHASLGKIYNQLKQYDKAVLHFGIALDLSPSP SDAVKI│
     Arath_CDC27B_Hobbit (678)│EELKEYAPSE SSVYALMGRIYKRRNMHDKAMLHFGLALDMKPPA TDVAAI│
           Soltu_CDC27  (684) │EELKEHAPRE SSVYALMGRIYKRRNMYDKAMLHFGVALDLKPSA TDVATI│
           Orysa_CDC27  (685) │ERLKEIAPHE SSMYALMGKIYKQLNILDKAVFCFGIALDLKPPA ADVAII│
      Sacof_CDC27 partial (630)│ERLKEIAPHE SSMYALMGKIYKQLNILDKAVFCFGIALDLKPPA ADLAII│
             Aspni_BIMA  (723) │KVLKDMAPDE ANVHYLLGKLYKMLRDKGNAIKHFTTALNLDPKA AQY--I│
             Schpo_nuc2+ (591) │EQLKAIAPDF ANVHFLLGKIFKQMRKKNLALKHFTIAWNLDGKA THI--I│
            Homsa_CDC27  (727) │EELKQIVPKE SLVYFLIGKVYKKLGQTHLALMNFSWAMDLDPKG ANN-QI│
               Consensus (751) │EELKEIAP E SSVYALMGKIYKQLNI DKAVLHFGIALDLKP A ADVA I│
                              └─────────────────────────┴─────────────────────────┘

801                                    849
          Arath_CDC27   (710) KAYMERLILPDELVTEENL-------------------------
     Arath_CDC27B_Hobbit (728) KAAMEKLHVPDEIDESP---------------------------
           Soltu_CDC27  (734) KAAIEKLHVPDEMEDEL---------------------------
           Orysa_CDC27  (735) KSAMEKVHLPDELMDDDDDDDEI---------------------
      Sacof_CDC27 partial (680) KSAMEKVHLPDELMEDDL--------------------------
             Aspni_BIMA  (771) KDAMEALDDDEEDEEDMA--------------------------
             Schpo_nuc2+ (639) KESIENLDIPEENLLTETGEIYRNLET-----------------
            Homsa_CDC27  (776) KEAIDKRYLPDDEEPITQEEQIMGTDESQESSMTDADDTQLHAAESDEF
               Consensus (801) KAAMEKLHLPDELMEDD
```

FIGURE 17 (continued)

| # | TC 895803 | Putative function |
|---|---|---|
| 1 | A.nidulans |NP363957 | bimA [Aspergillus nidulans] |
| 2 | Arabidopsis |TC264528 | CDC27/NUC2-like protein [Arabidopsis thaliana] HOBBIT protein |
| 3 | Arabidopsis |NP043602 | DNA binding protein (CDC27SH) isolog |
| 4 | C.elegans |TC134668 | (Q9N593) Metaphase-to-anaphase transition defect protein 1 |
| 5 | C.intestinalis |TC58032 | Ciona intestinalis cDNA, clone:cicl059p05, full insert sequence |
| 6 | Drosophila |TC172403 | CG8610-PA [Drosophila melanogaster] |
| 7 | Frog |TC288783 | Xenopus laevis NBRP cDNA clone:XL434l12ex, 5 prime end |
| 8 | G.gallus |TC210379 | (Q5ZK91) Hypothetical protein |
| 9 | Honeybee |TC10375 | (Q7QJW4) EbiP9284 (Fragment) |
| 10 | Human |THC2241027 | CDC27 protein [Homo sapiens] |
| 11 | Human |THC2235238 | H-NUC=[Homo sapiens] [824 aa] cell division cycle protein 27 homolog; nuc2 homolog |
| 12 | M.grisea |NP870483 | hypothetical protein MG06292.4 [Magnaporthe grisea 70-15] |
| 13 | Maize |TC251983 | (Q8LGU6) HOBBIT protein |
| 14 | Medaka |TC32541 | CDC27 protein |
| 15 | Medicago |TC104997 | (Q8LGU6) HOBBIT protein |
| 16 | Mosquito |NP1265145 | ENSANGP00000021543 [Anopheles gambiae str. PEST] |
| 17 | Mouse |TC1480020 | Human ribosomal DNA complete repeating unit |
| 18 | N.crassa |NP624892 | hypothetical protein [Neurospora crassa] |
| 19 | Pig |TC212778 | Human ribosomal DNA complete repeating unit |
| 20 | Potato |TC119704 | cell division cycle family protein / CDC family protein low similarity to SP|P30260| |
| 21 | R.trout |TC81012 | (Q7ZWD5) Cell division cycle 27 |
| 22 | Rat |TC539269 | CDC27 protein |
| 23 | Rice |NP1231881 | aminotransferase-like protein [Oryza sativa (japonica cultivar-group)] |
| 24 | S.cerevisiae |TC13353 | (P38042) Cell division control protein 27 |
| 25 | S.mansoni |TC11451 | Protein CDC27Hs (Cell division cycle protein 27 homolog) (H-NUC). [Human] |
| 26 | S.officinarum |TC52080 | (Q8LGU6) HOBBIT protein |
| 27 | S.pombe |TC6937 | nuclear scaffold-like protein p76 [Schizosaccharomyces pombe] |
| 28 | Soybean |TC210267 | (Q8LGU6) HOBBIT protein |
| 29 | Wheat |TC240260 | (Q69XV2) Putative HOBBIT |
| 30 | Zebrafish |TC291951 | (Q7ZWD5) Cell division cycle 27 |

Tentative ortholog/paralog list from TIGR, tentative TC895803 (from http://www.tigr.org/tigr-scripts/tgi/ego/ego_report.pl?ego=895803)

FIGURE 19

SEQ ID NO : 129, Arabidopsis thaliana 5' truncated
CDC27B/Hobbit nucleic acid sequence AC006081
ATGCAACAACTGTCAACTTCCCTCGGCTTAAACACTTACAACGAGGAACGTAATTCAACTTC
TACTAAAAACACGAGTTCTGAAGATTATAGTCCAAGGCAGTCTAAACACACACAAAGCCATG
GCCTTAAAGATATCTCCGGAAATTTCCATTCTCATGGAGTTAATGGAGGTGTTTCGAACATG
TCATTCTATAATACGCCTTCGCCAGTGGCTGCACAGCTATCCGGTATAGCTCCACCACCACT
TTTCCGGAATTTTCAGCCAGCTGTTGCAAACCCAAACTCCCTTATTACTGACAGTTCTCCAA
AGTCCACTGTTAACTCTACTCTTCAAGCACCTAGAAGAAAGTTTGTAGATGAAGGAAAGTTA
CGTAAGATTTCTGGCAGACTATTTTCTGATTCTGGTCCACGACGGAGTTCAAGACTGTCTGC
TGATTCAGGGGCAAACATTAATTCAAGTGTTGCAACAGTAAGCGGAAATGTGAACAACGCTT
CCAAGTATTTGGGAGGTTCTAAATTGAGTTCTTTGGCACTTCGTTCTGTAACACTTCGGAAG
GGACACTCCTGGGCAAATGAAAACATGGATGAAGGGGTCCGTGGGGAACCTTTTGATGATTC
AAGGCCTAATACTGCCTCAACGACTGGTTCTATGGCTTCCAATGATCAAGAAGACGAAACAA
TGTCGATTGGTGGCATAGCAATGAGTTCTCAAACAATCACAATTGGTGTTTCGGAAATTTTA
AACCTCCTTAGGACACTCGGAGAAGGGTGTAGACTTTCATACATGTACAGGTGTCAGGAGGC
ACTGGATACGTATATGAAACTTCCACATAAGCATTATAATACAGGATGGGTTCTTTCCCAGG
TCGGGAAAGCATACTTTGAACTAATTGACTATTTAGAGGCTGAAAAGGCATTCCGTCTTGCC
CGTCTGGCTTCTCCTTATTGCTTAGAAGGAATGGATATATACTCTACGGTCCTCTATCATTT
GAAGGAAGACATGAAGCTGAGTTACTTGGCTCAGGAACTAATATCAACCGATCGCTTAGCTC
CTCAATCTTGGTGTGCTATGGGAAATTGCTATAGCTTGCAAAAGGACCATGAGACCGCACTG
AAGAATTTCCTACGAGCTGTTCAACTGAATCCAAGATTTGCATATGCACATACCTTATGTGG
CCACGAATACACAACTCTTGAGGATTTTGAGAACGGAATGAAAAGTTACCAAAACGCACTTC
GTGTAGATACAAGACACTACAACGCATGGTACGGGCTTGGAATGATATATCTACGCCAAGAG
AAGTTAGAGTTCTCAGAGCATCACTTCAGAATGGCTTTCCTAATAAACCCGAGTTCCTCTGT
TATAATGTCTTATTTAGGGACATCTTTGCATGCCTTGAAGAGAAGTGAGGAAGCACTAGAGA
TAATGGAGCAAGCCATAGTAGCAGATAGAAAAAACCCTCTTCCAATGTACCAGAAAGCTAAC
ATACTTGTCTGCTTAGAAAGATTAGATGAAGCTCTAGAAGTTCTTGAGGAGCTCAAAGAGTA
TGCGCCTTCAGAGAGCAGCGTTTACGCTTTAATGGGCAGGATCTATAAGCGGCGAAACATGC
ACGATAAAGCCATGCTTCATTTCGGTCTAGCTTTAGATATGAAACCGCCTGCAACTGACGTT
GCTGCAATAAAGGCTGCAATGGAGAAATTGCATGTTCCAGATGAGATCGATGAGAGCCCGTG
A SEQ ID NO : 130, Arabidopsis thaliana N-terminal truncated
CDC27B/hobbit amino acid sequence
MQQLSTSLGLNTYNEERNSTSTKNTSSEDYSPRQSKHTQSHGLKDISGNFHSHGVNGGVSNM
SFYNTPSPVAAQLSGIAPPPLFRNFQPAVANPNSLITDSSPKSTVNSTLQAPRRKFVDEGKL
RKISGRLFSDSGPRRSSRLSADSGANINSSVATVSGNVNNASKYLGGSKLSSLALRSVTLRK
GHSWANENMDEGVRGEPFDDSRPNTASTTGSMASNDQEDETMSIGGIAMSSQTITIGVSEIL
NLLRTLGEGCRLSYMYRCQEALDTYMKLPHKHYNTGWVLSQVGKAYFELIDYLEAEKAFRLA
RLASPYCLEGMDIYSTVLYHLKEDMKLSYLAQELISTDRLAPQSWCAMGNCYSLQKDHETAL
KNFLRAVQLNPRFAYAHTLCGHEYTTLEDFENGMKSYQNALRVDTRHYNAWYGLGMIYLRQE
KLEFSEHHFRMAFLINPSSSVIMSYLGTSLHALKRSEEALEIMEQAIVADRKNPLPMYQKAN
ILVCLERLDEALEVLEELKEYAPSESSVYALMGRIYKRRNMHDKAMLHFGLALDMKPPATDV
AAIKAAMEKLHVPDEIDESP

FIGURE 20

SEQ ID NO : 131, Arabidopsis thaliana full length CDC27B/Hobbit nucleic acid AJ487669 nucleic acid sequence
ATGGAAGCTATGCTTGTGGACTGTGTAAACAACAGTCTTCGTCATTTTGTCTACAAAAATGC
TATTTTCATGTGCGAGCGTCTCTGCGCTGAGTTTCCTTCTGAGGTTAATTTGCAGCTATTAG
CCACCAGCTACCTGCAGAATAATCAAGCTTACAGTGCATATCATCTGCTAAAGGGAACACAA
ATGGCTCAGTCCCGATACTTGTTCGCATTATCATGCTTCCAGATGGACCTTCTCAATGAAGC
TGAATCTGCACTCTGCCCTGTTAATGAACCTGGTGCGGAGATCCCAAATGGTGCAGCAGGCC
ATTACCTTCTTGGACTTATTTACAAGTATACTGATAGAAGGAAGAATGCTGCTCAACAATTT
AAACAGTCCTTGACAATAGACCCTCTACTTTGGGCTGCATATGAGGAATTATGTATATTAGG
TGCTGCTGAGGAAGCAACTGCAGTTTTTGGTGAAACAGCTGCTCTCTCCATTCAAAAGCAGT
ATATGCAACAACTGTCAACTTCCCTCGGCTTAAACACTTACAACGAGGAACGTAATTCAACT
TCTACTAAAAACACGAGTTCTGAAGATTATAGTCCAAGGCAGTCTAAACACACACAAAGCCA
TGGCCTTAAAGATATCTCCGGAAATTTCCATTCTCATGGAGTTAATGGAGGTGTTTCGAACA
TGTCATTCTATAATACGCCTTCGCCAGTGGCTGCACAGCTATCCGGTATAGCTCCACCACCA
CTTTTCCGGAATTTTCAGCCAGCTGTTGCAAACCCAAACTCCCTTATTACTGACAGTTCTCC
AAAGTCCACTGTTAACTCTACTCTTCAAGCACCTAGAAGAAAGTTTGTAGATGAAGGAAAGT
TACGTAAGATTTCTGGCAGACTATTTTCTGATTCTGGTCCACGACGGAGTTCAAGACTGTCT
GCTGATTCAGGGGCAAACATTAATTCAAGTGTTGCAACAGTAAGCGGAAATGTGAACAACGC
TTCCAAGTATTTGGGAGGTTCTAAATTGAGTTCTTTGGCACTTCGTTCTGTAACACTTCGGA
AGGGACACTCCTGGGCAAATGAAAACATGGATGAAGGGGTCCGTGGGGAACCTTTTGATGAT
TCAAGGCCTAATACTGCCTCAACGACTGGTTCTATGGCTTCCAATGATCAAGAAGACGAAAC
AATGTCGATTGGTGGCATAGCAATGAGTTCTCAAACAATCACAATTGGTGTTTCGGAAATTT
TAAACCTCCTTAGGACACTCGGAGAAGGGTGTAGACTTTCATACATGTACAGGTGTCAGGAG
GCACTGGATACGTATATGAAACTTCCACATAAGCATTATAATACAGGATGGGTTCTTTCCCA
GGTCGGGAAAGCATACTTTGAACTAATTGACTATTTAGAGGCTGAAAAGGCATTCCGTCTTG
CCCGTCTGGCTTCTCCTTATTGCTTAGAAGGAATGGATATATACTCTACGGTCCTCTATCAT
TTGAAGGAAGACATGAAGCTGAGTTACTTGGCTCAGGAACTAATATCAACCGATCGCTTAGC
TCCTCAATCTTGGTGTGCTATGGGAAATTGCTATAGCTTGCAAAAGGACCATGAGACCGCAC
TGAAGAATTTCCTACGAGCTGTTCAACTGAATCCAAGATTTGCATATGCACATACCTTATGT
GGCCACGAATACACAACTCTTGAGGATTTTGAGAACGGAATGAAAAGTTACCAAAACGCACT
TCGTGTAGATACAAGACACTACAACGCATGGTACGGGCTTGGAATGATATATCTACGCCAAG
AGAAGTTAGAGTTCTCAGAGCATCACTTCAGAATGGCTTTCCTAATAAACCCGAGTTCCTCT
GTTATAATGTCTTATTTAGGGACATCTTTGCATGCCTTGAAGAGAAGTGAGGAAGCACTAGA
GATAATGGAGCAAGCCATAGTAGCAGATAGAAAAAACCCTCTTCCAATGTACCAGAAAGCTA
ACATACTTGTCTGCTTAGAAAGATTAGATGAAGCTCTAGAAGTTCTTGAGGAGCTCAAAGAG
TATGCGCCTTCAGAGAGCAGCGTTTACGCTTTAATGGGCAGGATCTATAAGCGGCGAAACAT
GCACGATAAAGCCATGCTTCATTTCGGTCTAGCTTTAGATATGAAACCGCCTGCAACTGACG
TTGCTGCAATAAAGGCTGCAATGGAGAAATTGCATGTTCCAGATGAGATCGATGAGAGCCCG
TGA SEQ ID NO : 132, Arabidopsis thaliana full length CDC27B/Hobbit amino acid sequence
MEAMLVDCVNNSLRHFVYKNAIFMCERLCAEFPSEVNLQLLATSYLQNNQAYSAYHLLKGTQ
MAQSRYLFALSCFQMDLLNEAESALCPVNEPGAEIPNGAAGHYLLGLIYKYTDRRKNAAQQF
KQSLTIDPLLWAAYEELCILGAAEEATAVFGETAALSIQKQYMQQLSTSLGLNTYNEERNST
STKNTSSEDYSPRQSKHTQSHGLKDISGNFHSGVNGGVSNMSFYNTPSPVAAQLSGIAPPP
LFRNFQPAVANPNSLITDSSPKSTVNSTLQAPRRKFVDEGKLRKISGRLFSDSGPRRSSRLS FIGURE 20 (continued)

ADSGANINSSVATVSGNVNNASKYLGGSKLSSLALRSVTLRKGHSWANENMDEGVRGEPFDD
SRPNTASTTGSMASNDQEDETMSIGGIAMSSQTITIGVSEILNLLRTLGEGCRLSYMYRCQE
ALDTYMKLPHKHYNTGWVLSQVGKAYFELIDYLEAEKAFRLARLASPYCLEGMDIYSTVLYH
LKEDMKLSYLAQELISTDRLAPQSWCAMGNCYSLQKDHETALKNFLRAVQLNPRFAYAHTLC
GHEYTTLEDFENGMKSYQNALRVDTRHYNAWYGLGMIYLRQEKLEFSEHHFRMAFLINPSSS
VIMSYLGTSLHALKRSEEALEIMEQAIVADRKNPLPMYQKANILVCLERLDEALEVLEELKE
YAPSESSVYALMGRIYKRRNMHDKAMLHFGLALDMKPPATDVAAIKAAMEKLHVPDEIDESP

SEQ ID NO : 133, Arabidopsis thaliana CDC27a nucleic acid sequence NM_112503.2
ATGATGGAGAATCTACTGGCGAATTGTGTCCAGAAAAACCTTAACCATTTTATGTTCACCAA
TGCTATCTTCCTTTGCGAACTTCTTCTCGCCCAATTTCCATCTGAGGTGAACCTGCAATTGT
TAGCCAGGTGTTACTTGAGTAACAGTCAAGCTTATAGTGCATATTATATCCTTAAAGGTTCA
AAAACGCCTCAGTCTCGGTATTTATTTGCATTCTCATGCTTTAAGTTGGATCTTCTTGGAGA
GGCTGAAGCTGCATTGTTGCCCTGTGAAGATTATGCTGAAGAAGTTCCTGGTGGTGCAGCTG
GGCATTATCTTCTTGGTCTTATATATAGATATTCTGGGAGGAAGAACTGTTCAATACAACAG
TTTAGGATGGCATTGTCATTTGATCCATTGTGTTGGGAAGCATATGGAGAACTTTGTAGTTT
AGGTGCCGCTGAAGAAGCCTCAACAGTTTTCGGGAATGTTGCTTCCCAGCGTCTTAAAACTT
GTGTAGAACAAAGAATAAGCTTCTCAGAAGGAGCAACCATAGACCAGATTACAGATTCTGAT
AAGGCCTTAAAAGATACAGGTTTATCGCAAACAGAACACATTCCAGGAGAGAACCAACAAGA
TCTGAAAATTATGCAGCAGCCTGGAGATATTCCACCAAATACTGACAGGCAACTTAGTACAA
ACGGATGGGACTTGAACACACCTTCTCCAGTGCTTTACAGGTAATGGATGCTCCACCGCCT
CTGCTTCTTAAGAATATGCGTCGTCCAGCAGTGGAAGGATCTTTGATGTCTGTACATGGAGT
GCGTGTGCGTCGAAGAAACTTTTTTAGTGAAGAATTGTCAGCAGAGGCTCAAGAAGAATCTG
GGCGCCGCCGTAGTGCTAGAATAGCAGCAAGGAAAAAGAATCCTATGTCGCAGTCATTTGGA
AAAGATTCCCATTGGTTACATCTTTCACCTTCCGAGTCAAACTATGCACCTTCTCTTTCCTC
GATGATTGGAAAATGCAGAATCCAAAGCAGCAAAGAAGCGATTCCTGATACCGTTACTCTAA
ATGATCCAGCAACGACGTCAGGCCAGTCTGTAAGTGACACTGGAAGCTCTGTTGATGATGAG
GAAAAGTCAAATCCTAGTGAATCTTCCCCGGATCGTTTCAGCCTTATTTCTGGAATTTCAGA
AGTGCTAGGCATTCTGAAAATTCTTGGAGATGGCCACAGGCATTTACATATGTACAAGTGTC
AGGAAGCTTTGTTGGCATATCAAAAGCTATCTCAGAAACAATACAATACACACTGGGTTCTC
ATGCAGGTTGGAAAAGCATATTTTGAGCTACAAGACTACTTCAACGCTGACTCTTCCTTTAC
TCTTGCTCATCAAAAGTATCCTTATGCTTTGGAAGGAATGGATACATACTCCACTGTTCTTT
ATCACCTGAAAGAAGAGATGAGGTTGGGCTATCTGGCTCAGGAACTGATTTCAGTTGATCGC
CTGTCTCCAGAATCCTGGTGTGCAGTTGGGAACTGTTACAGTTTGCGTAAGGATCATGATAC
TGCTCTCAAAATGTTTCAGAGAGCTATCCAACTGAATGAAAGATTCACATATGCACATACCC
TTTGTGGCCACGAGTTTGCCGCATTGGAAGAATTCGAGGATGCAGAGAGATGCTACCGGAAG
GCTCTGGGCATAGATACGAGACACTATAATGCATGGTACGGTCTTGGAATGACCTATCTTCG
TCAGGAGAAATTCGAGTTTGCGCAGCATCAATTTCAACTGGCTCTCCAAATAAATCCAAGAT
CTTCAGTCATCATGTGTTACTATGGAATTGCTTTGCATGAGTCAAAGAGAAACGATGAGGCG
TTGATGATGATGGAGAAGGCTGTACTCACTGATGCAAAGAATCCGCTCCCCAAGTACTACAA
GGCTCACATATTAACCAGCCTAGGTGATTATCACAAAGCACAGAAAGTTTTAGAAGAGCTCA
AAGAATGTGCTCCTCAAGAAAGCAGTGTCCATGCATCGCTTGGCAAAATATACAATCAGCTA
AAGCAATACGACAAAGCCGTGTTACATTTCGGCATTGCTTTGGATTTAAGCCCTTCTCCATC
TGATGCTGTCAAGATAAAGGCTTACATGGAGAGGTTGATACTACCAGACGAGCTGGTGACGG
AGGAAAATTTG

SEQ ID NO : 134, Arabidopsis thaliana CDC27a amino acid sequence NM_112503.2
MMENLLANCVQKNLNHFMFTNAIFLCELLLAQFPSEVNLQLLARCYLSNSQAYSAYYILKGS
KTPQSRYLFAFSCFKLDLLGEAEAALLPCEDYAEEVPGGAAGHYLLGLIYRYSGRKNCSIQQ
FRMALSFDPLCWEAYGELCSLGAAEEASTVFGNVASQRLQKTCVEQRISFSEGATIDQITDS
DKALKDTGLSQTEHIPGENQQDLKIMQQPGDIPPNTDRQLSTNGWDLNTPSPVLLQVMDALP
PLLLKNMRRPAVEGSLMSVHGVRVRRRNFFSEELSAEAQEESGRRRSARIAARKKNPMSQSF
GKDSHWLHLSPSESNYAPSLSSMIGKCRIQSSKEVIPDTVTLNDPATTSGQSVSDIGSSVDD
EEKSNPSESSPDRFSLISGISEVLSLLKILGDGHRHLHMYKCQEALLAYQKLSQKQYNTHWV
LMQVGKAYFELQDYFNADSSFTLAHQKYPYALEGMDTYSTVLYHLKEEMRLGYLAQELISVD
RLSPESWCAVGNCYSLRKDHDTALKMFQRAIQLNERFTYAHTLCGHEFAALEEFEDAERCYR
KALGIDTRHYNAWYGLGMTYLRQEKFEFAQHQFQLALQINPRSSVIMCYYGIALHESKRNDE
ALMMMEKAVLTDAKNPLPKYYKAHILTSLGDYHKAQKVLEELKECAPQESSVHASLGKIYNQ
LKQYDKAVLHFGIALDLSPSPSDAVKIKAYMERLILPDELVTEENL

SEQ ID NO : 135, Oryza sativa CDC27 AP003539.3 nucleic acid sequence
ATGGAAACCCTAATGGTGGACCGCGTCCACGGCAGCCTCCGCCTCTTCATGCACCGCAACGC
CGTCTTCCTCTGCGAGCGCCTCTGCGCCCAGTTCCCCGCCGAGACAAATGTCCAGTTGTAGC
AACTTGCTACCTTCACAACAACCAGCCATATGCTGCATACCACATCTTGAAAGGAAAGAAGC
TGCCAGAGTCCCGGTACTTGTTTGCTATGTCATGCTTCCGAATGAACCTCTTACGGGAAGCT
GAAGAAGCCTTGTGTCCTGTCAATGAACCAAATATTGAGGTTCCAAGTGGTGCAACAGGGCA
CTACCTTCTTGGAGTAATTTACAGGTACACTGGCAGAGTGGAAGCTGCAGCTGAGCAATTTG
TACAAGCTCTGACTCTTGATCCTCTTCTATGGGCAGCATACGAGGAATTGTGCATACTAGGT
GTTGCTGAAGATGCAAATGAATGTTTCAGTGAAGCAACAGCTCTACGTCTTCAGCAGGAACT
CACATCCACATCAAATGTGGAAAAGTCAAACTTTGTTAATGAAAATCGGTTTCTATCTTCCA
ATGTGTCAGCAAGTTTTGGTGATAGTCCTAAGCAAATTAAACAGCTGCATGCTAACACCACT
GCAGAAGTATCTGGTTATCCTCATGTAAAGTCAACTGCATTGCATATGCAGAACGGTGCACC
ATCTAATTTATCACAGTTTGACACTCCATCGCCAACTTCAACGCAGNNNNATAATGTAACTT
CAACTTCGTCTTCTACAAGTATAGTTGATGGAAGATATCCCGAGCAAGAGAAATCTGAACGA
GTTCTGTCACAGGACTCCAAATTAGCTATTGGTATCAGGGAGCTAATGGCACTCTTGCGGAC
ACTAGGGGAAGGGTATAGGCTTTCTTGCTTGTTTAAGTGTCAGGAAGCATTGGAAGTATATA
GAAAGCTCCCAGAGGCACAATTTAATACTGGATGGGTTCTTTGCCAGGTTGGGAAGACATAT
TTTGAACTCGTCAATTATTTAGAAGCCGATCATTTTTTTGAGTTAGCGCATCGACTATCACC
ATGCACGTTGGAGGGAATGGACATTTACTCCACTGTTCTTTATCATTTGAATGAGGAAATGC
GGCTAAGTTACCTTGCTCAAGATCTTGTTTCTATTGATCGACTATCTCCCCAAGCATGGTGT
GCTGTGGGAAATTGCTTTGCCTTGAGGAAAGATCATGAGACTGCCTTGAAGAATTTTCAACG
TGCTGTACAGCTTGACTCAAGAGTTGCATACGCTCACACGCTATGCGGTCACGATATAAAAC
TATACCGATCTGCACTTCAGGTAGATGAAAGACACTACAATGCCTGGTATGGCCTTGGAGTG
GTGTACCTTCGCCAGGAAAGTTTGAGTTTGCTGAGCATCATTTCAGAAGGGCATTCCAGAT
AAATCCTTGCTCTTCTGTTCTTATGTGCTATCTTGGGATGGCCTTGCATGCTTTAAAGAGGA
ATGAGGAAGCCTTGGAAATGATGGAGAAGGCTATATTTGCTGATAAGAAGAATCCACTCCCC
AAGTATCAAAAGGCTTTAATCCTTCTAGGCCTACAAAAATACCCTGATGCTCTGGATGAGTT
GGAACGGCTAAAGGAAATTGCACCTCATGAAGTAGTATGTATGCACTGATGGGAAGATTT
ACAAGCAACTTAACATTCTTGACAAGGCTGTATTTTGCTTTGGCATTGCCCTGGATTTGAAA
CCTCCTGCTGCTGACGTTGCTATAATACAATCTGCAATGGAGAAAGTACACCTTCCAGATGA
ACTTATGGATGATGATGATGATGATGATGAGATTTAA

FIGURE 20 (continued)

SEQ ID NO : 136, Oryza sativa CDC27 AP003539.3 amino acid sequence
METLMVDRVHGSLRLFMHRNAVFLCERLCAQFPAEVNVQLLATCYLHNNQPYAAYHILKGKK
LPESRYLFAMSCFRMNLLREAEEALCPVNEPNIEVPSGATGHYLLGVIYRYTGRVEAAAEQF
VQALTLDPLLWAAYEELCILGVAEDANECFSEATALRLQQELTSTSNVEKSNFVNENRFLSS
NVSASFGDSPKQIKQLHANTTAEVSGYPHVKSTALHMQNGAPSNLSQFDTPSPTSTQVSGIA
PPPLFRNMHAYQNTAGGNAPSKPKVNAPNLTLRRKYIDEAGLKKVSGRLFNQSSDSVPRRSA
RLSRDTTINSNSNISQFGGNGTDHSSGKLRVNSSTPSKLCSTALRSVQVRKGKPQATENFDE
GDYHFDMDDSVTSTSSSTSIVDGRYPEQEKSERVLSQDSKLAIGIRELMALLRTLGEGYRLS
CLFKCQEALEVYRKLPEAQFNTGWVLCQVGKTYFELVNYLEADHFFELAHRLSPCTLEGMDI
YSTVLYHLNEEMRLSYLAQDLVSIDRLSPQAWCAVGNCFALRKDHETALKNFQRAVQLDSRV
AYAHTLCGHEYSALEDYENSIKLYRSALQVDERHYNAWYGLGVVYLRQEKFEFAEHHFRRAF
QINPCSSVLMCYLGMALHALKRNEEALEMMENAIFADKKNPLPKYQKALILLGLQKYPDALD
ELERLKEIAPHESSMYALMGKIYKQLNILDKAVFCFGIALDLKPPAADVAIIKSAMEKVHLP
DELMDDDDDDDEI

SEQ ID NO : 137, Solanum tuberosum CDC27 BG887406.1 BG590616.1 DN939130.1 CV470643.1 compiled ESTs
ATGGAAACCCTACTAGCTGAATCTGTGCAAAACAGCCTTGGCCAATTTATGTACCACAACGC
CATTTTCATGTGTGAACGACTCTGTGCCGAGTTCCCCACTGAGACAAATATGCAGCTTTTAG
CTGGCTGCTACCTGCACAACCAACAGGCTTATGCTGCATATCATCTTCTCAAGGGGACAAGT
ATGGCTCAATCCCGCTACTTGTTTGCACTATCATGCTTTCAGATGGATCTTCTCACTGAAGC
TGAGACAGCACTTTGCCCTCCTAATGAGCCAACTGCAGAGGTTCCAAATGGTGCAGCTGGGC
ATTACCTTCTTGGTCTTATTTACAGGTATACAGATAGAAGAAATAGTTCCATCCAGCATTTC
AATCAGGCATTGTTATTGGATCCATTGCTATGGGCTGCATATGAGGAGTTGTGTATACTAGG
TGCTGCAGAAGAAGCAGCTGCAGTTTTTGGGGAAGCATCTTTGCTTTGCATTCAGAAACAAC
ACATAGACCAAGGGAACCAATCTCAAAATTTACAAGCATCCACTGATGATCAGAATGTAGCT
TCTACGAATATTGTCTCAGGCGACATCAGCCCTATGCAATCAAAACATACACACAGCCATAA
TCTTCGAGAAATGTCTGGAAATTATAATGGAGCAGCTGCTATCCAGAATTTAGGTGGGGTTT
CTACTAACATGTCATTCTACAACACTCCCTCACCAATGGCATCACAGTTGTCAGGAGTGGTT
CCACCTCCAGTTTGTAGAAATTTTCAGCAAAATGGAACTAATGCATCTGTGGCTGGTGCTGA
TAATTCTCCACGAGCAACTGTCAATTCAACCATTCAGGCCCCTCGGAGAAAGTTTGTTGATG
AGGGGAAGTTAAGAAAGATATCTGGGAGGTTATTTTCTGATTCTGGCCCTCGACGAAATTCA
AGGCTTGCTGGAGAATCTACTGGAAACACAAATTCAAATGTATCTGGTGCTTCTGGAAATGG
AACAATTCATTCTTCCAAATATTATGGTAGTTCGAAGCTGAGCTCAATGACTTTACGTTCCA
TGACAAGTCGAAAGGCACAATCTTGGGCTACCGAAAACTATGGTGAAGGGACTCGCAATGAC
ATTTCTAATGATTCTCGGCTAAATATGACTATGTCACACCCTTCTGGAGATGCTAGACCTCT
TGAACAAGAAAGGCCCCGAACTTCTGCTTCTGGGGTTAATGTAAGCAGCACATCTATCCCTC
TCAGTGCTTCAGAGATATTGGCCCTTTTCAGGTTTCTTGGGGAAGGCTATAGACTTTCTTGT
TTATATAGATGTCAGGATGCACTGGATGTTTATAACAAACTCCCACACAAACATTATCACAC
TGGATGGGTTCTTTCTCAGATTGGAAGAGCATACTTCGAAATGGTTGATTACCTAGAAGCAG
ATCATGCATTTGGCCTTGCTCGTCTGGCCTCACCTTATAGTTTAGAAGGAATGGACGTGTAC
TCGACAGTGTTGTTTCATCTCAAGGAGGACATGAAGTTGAGCTATCTGGCGCAGGTGCTGGT
ATCAACTGATAGATTAGCTCCTCAATCTTGGTGTGCTATGGGGAATTGCTATAGTTTACAGA
AAGACCATGAAACTGCTCTTAAAAATTTTCAACGAGCTGTACAACTAAATCCTAGATTTGCA
TACGGGCACACGCTTTGTGGTCATGAATATGTTGCTTTAGAAGATTTTGAAAATGCTATTAA

```
GAGCTATCAGAGTGCACTTCGTGTGGATGCCAGGCATTACAATGCCTGGTATGGGCTTGGAA
TGATCTATCTCCGACAGGAGAAGTTTGAATTTTCAGAGCATCACTTTCGAATGGCTTTGGGT
ATAAATCCACAGTCTTCTGTTATCATGTCATATCTTGGCACTGCATTACACGCTCTGAAGAA
AAATGAAGAGGCATTGGAAGTGATGGAGCTGGCTATTGTAGCAGACAAGAAAAACCCTCTTC
CAATGTATCAGAAGGCTAACATCCTTGTGAGCACGGAAAGTTTTGATGCCGCTTTAGAAGTC
TTAGAGGAACTTAAAGAGCATGCTCCTCGTGAGAGCAGTGTCTATGCTTTGATGGGTCGGAT
ATACAAGAGGCGTAATATGTACGACAAAGCCATGCTTCATTTTGGAGTGGCATTAGATTTAA
AACCATCTGCAACTGATGTTGCTACCATTAAGGCTGCCATTGAAAAGCTGCATGTACCAGAT
GAGATGGAAGATGAATTATAA
```

SEQ ID NO : 138, Solanum tuberosum CDC27 amino acid sequence
```
METLLAESVQNSLGQFMYHNAIFMCERLCAEFPTETNMQLLAGCYLHNQQAYAAYHLLKGTS
MAQSRYLFALSCFQMDLLTEAETALCPPNEPTAEVPNGAAGHYLLGLIYRYTDRRNSSIQHF
NQALLLDPLLWAAYEELCILGAAEEAAAVFGEASLLCIQKQHIDQGNQSQNLQASTDDQNVA
STNIVSGDISPMQSKHTHSHNLREMSGNYNGAAAIQNLGGVSTNMSFYNTPSPMASQLSGVV
PPPVCRNFQQNGTNASVAGADNSPRATVNSTIQAPRRKFVDEGKLRKISGRLFSDSGPRRNS
RLAGESTGNTNSNVSGASGNGTIHSSKYYGSSKLSSMTLRSMTSRKAQSWATENYGEGTRND
ISNDSRLNMTMSHPSGDARPLEQERPRTSASGVNVSSTSIPLSASEILALFRFLGEGYRLSC
LYRCQDALDVYNKLPHKYHTGWVLSQIGRAYFEMVDYLEADHAFGLARLASPYSLEGMDVY
STVLFHLKEDMKLSYLAQVLVSTDRLAPQSWCAMGNCYSLQKDHETALKNFQRAVQLNPRFA
YGHTLCGHEYVALEDFENAIKSYQSALRVDARHYNAWYGLGMIYLRQEKFEFSEHHFRMALG
INPQSSVIMSYLGTALHALKKNEEALEVMELAIVADKKNPLPMYQKANILVSTESFDAALEV
LEELKEHAPRESSVYALMGRIYKRRNMYDKAMLHFGVALDKPSATDVATIKAAIEKLHVPD
EMEDEL
```

SEQ ID NO : 139, Schizosaccharomyces pombe nuc2+ CDC27-like nucleic acid sequence NM_001020032.1
```
ATGACAGATCGATTGAAATGTTTAATATGGTATTGCATTGATAATCAGAATTATGATAATTC
AATTTTTTATTCAGAACGTTTACATGCAATTGAAGATTCAAACGAGAGTTTGTATCTTTTGG
CATATTCGCATTTCCTAAACCTCGATTACAATATTGTATACGACTTATTAGATAGAGTAATT
AGTCATGTTCCTTGCACATACTTATTTGCAAGGACCAGCCTTATTTTAGGCAGATATAAACA
AGGAATAAGTGCTGTGGAGGCCTGTCGATCGAATTGGCGCTCCATTCAGCCAAACATAAATG
ACTCAATTAGCAGTCGTGGACATCCAGATGCCTCTTGCATGCTTGATGTTTTGGGTACTATG
TATAAAAAGGCAGGGTTCCTCAAAAAAGCTACAGATTGTTTTGTAGAAGCTGTCTCCATTAA
CCCATATAATTTCTCTGCTTTCCAGAATTTAACTGCAATAGGCGTGCCACTCGATGCTAATA
ATGTATTTGTTATTCCACCCTACCTTACGGCAATGAAGGGTTTTGAAAAATCTCAAACGAAT
GCTACAGCTTCGGTACCAGAACCGTCTTTTTTGAAGAAAGTAAAGAGTCTTCCTCATCTTC
CAACAAGTTTTCGGTTTCTGAATCGATAGCAAATAGTTATTCAAACTCATCCATTTCAGCAT
TTACTAAGTGGTTTGATAGGGTTGACGCTTCTGAGCTTCCAGGAAGTGAGAAGGAACGACAT
CAAAGCTTGAAATTACAATCTCAATCTCAGACTAGCAAAAACCTTTTGGCTTTCAATGATGC
TCAAAAAGCTGATTCTAACAATAGGGATACGTCTTTAAAATCCCACTTTGTGGAACCTAGAA
CCCAAGCATTAAGACCAGGAGCTCGTTTAACATATAAATTACGCGAAGCGAGAAGTTCTAAA
AGAGGAGAGAGCACACCTCAAAGCTTCCGCGAAGAGGACAATAATTTGATGGAATTACTAAA
GTTATTCGGTAAGGGTGTTTACCTGCTCGCCCAGTATAAGTTACGAGAGGCTTTAAATTGTT
TCCAAAGCTTGCCCATCGAACAGCAAAATACACCTTTTGTTCTTGCAAAGCTTGGAATAACC
TACTTTGAACTGGTTGATTACGAAAAATCTGAAGAAGTGTTTCAAAAATTAAGGGACTTGTC
GCCTTCACGTGTCAAAGATATGGAAGTCTTTTCAACTGCACTTTGGCATTTGCAAAAGTCTG
```

FIGURE 20 (continued)

```
TTCCTTTATCTTACCTTGCCCATGAAACTTTGGAAACTAATCCTTATTCCCCAGAATCATGG
TGCATTCTTGCTAATTGCTTCTCACTTCAACGTGAACACTCGCAGGCATTAAAATGTATTAA
TAGAGCTATTCAATTGGATCCAACTTTTGAATATGCTTATACGCTTCAAGGGCACGAGCATT
CTGCAAACGAAGAATACGAAAAATCGAAAACATCTTTCCGCAAAGCAATTAGAGTAAATGTT
CGACATTACAATGCATGGTATGGCCTGGGAATGGTTTATTTAAAAACAGGGCGAAATGATCA
AGCAGACTTTCATTTTCAACGTGCTGCAGAGATCAATCCTAACAACTCTGTACTCATCACTT
GTATTGGTATGATTTACGAACGCTGCAAAGATTACAAAAAAGCACTTGATTTTTATGATCGG
GCATGTAAACTGGATGAAAAGTCTTCGCTTGCCAGGTTCAAGAAAGCCAAAGTGCTTATTTT
ATTACATGATCACGATAAAGCACTCGTTGAATTGGAACAATTAAAGGCAATTGCGCCAGATG
AAGCAAATGTTCATTTTTGCTCGGCAAAATTTTCAAGCAAATGCGGAAAAAAAATTTAGCC
TTAAAGCACTTCACTATAGCATGGAACTTAGACGGCAAGGCTACGCATATTATTAAGGAATC
GATTGAAAATCTGGATATTCCCGAAGAAATTTGTTAACTGAAACAGGTGAAATTTATAGGA
ATCTGGAAACTTAA
```

SEQ ID NO : 140, Schizosaccharomyces pombe nuc2+ CDC27-like amino acid sequence
```
MTDRLKCLIWYCIDNQNYDNSIFYSERLHAIEDSNESLYLLAYSHFLNLDYNIVYDLLDRVI
SHVPCTYLFARTSLILGRYKQGISAVEACRSNWRSIQPNINDSISSRGHPDASCMLDVLGTM
YKKAGFLKKATDCFVEAVSINPYNFSAFQNLTAIGVPLDANNVFVIPPYLTAMKGFEKSQTN
ATASVPEPSFLKKSKESSSSSNKFSVSESIANSYSNSSISAFTKWFDRVDASELPGSEKERH
QSLKLQSQSQTSKNLLAFNDAQKADSNNRDTSLKSHFVEPRTQALRPGARLTYKLREARSSK
RGESTPQSFREEDNNLMELLKLFGKGVYLLAQYKLREALNCFQSLPIEQQNTPFVLAKLGIT
YFELVDYEKSEEVFQKLRDLSPSRVKDMEVFSTALWHLQKSVPLSYLAHETLETNPYSPESW
CILANCFSLQREHSQALKCINRAIQLDPTFEYAYTLQGHEHSANEEYEKSKTSFRKAIRVNV
RHYNAWYGLGMVYLKTGRNDQADFHFQRAAEINPNNSVLITCIGMIYERCKDYKKALDFYDR
ACKLDEKSSLARFKKAKVLILLHDHDKALVELEQLKAIAPDEANVHFLLGKIFKQMRKKNLA
LKHFTIAWNLDGKATHIIKESIENLDIPEENLLTETGEIYRNLET
```

SEQ ID NO : 141, Aspergillus niger bimA CDC27-like nucleic acid sequence X59269.1
```
ATGACTCCGTCCACATCACATATTTCGAGCCAGCTAAGGCAGCTGATATATTACCATCTTGA
CAACAACCTTGCTCGGAACGCGCTGTTCCTTGCCGGTCGTTTACACGCCTACGAACCTCGGA
CGTCGGAAGCTTCGTACCTATTAGCTCTGTGTTACCTACAAAATGGTCAGGTGAAAGCAGCA
TGGGAAACTAGCAAGCATTTTGGGTCGAGGGGTGCGCATCTTGGATGTTCTTACGTCTACGC
GCAGGCTTGTCTTGACCTCGGGAAATATACGGACGGTATTAACGCGCTAGAGCGAAGTAAGG
GACAATGGACTTCGCGAAACCACTGGAATAAACACAGTGAGACGCGACGACAACACTTGCCG
GATGCTGCGGCAGTTTATGTTTGCAAGGAAAATTATGGCAGGCACACAAGGAACACAACAA
GGCTGTGGAGTGTTACGCTGCAGCTTTAAAGCTGAATCCCTTCATGTGGGATGCATTCTTGA
ATCTGTGCGAAACTGGTGTTGATTTGCGTGTTTCAAACATATATAAGATGAGCCCGGAATTG
TACAGCATGGTATCGTCTGCTGCGCTCGAAGATGTTGAATCCCAGGTTCTACCTCCGGACGG
TCCACTCCAGACACAAGTTAACCCAAATCCGAGCTTGGACCCGTTCACTGCCGGTACGACTC
GCAGCGATTCGACCTCTACTCACGGGAGCTCAGCTTTGTGGGAAAAGTTGAATGGAAGCACA
GTTAGTGTGGCATCTTCAGGAACAGGACCGCATCTTCCGCGGGAAGGCATGGAGACTCCTGG
TGGCCAAAGTAGCGAATCTGATGATCCACGTGTAACCAACGGTAATGGCACAGATGTTTTTG
AGCCGCCGCTAGCCCCTGCAAAGAAGAATCGAACGATCCAAACAATAGGCGGCGATCATCCG
ATGGATCCCCCGCCAAAGATGCGGCCAACCGGTATTCGACCGAGGACCCGAACCAAATTCGA
GTCAGATGAAGGTCATACTGAGAGAGACGCGGGCATGGGTCACAGGTTAGGCGATCGGAAAC
```

FIGURE 20 (continued)

```
GAACGGTCTCTGGACAAGTTGCGCATCCGTCGGTACCGCATTCAACCGACCAAGGTGTCGGG
CAACGGCGAAGTGTACGTCTCTTTAACCAGATAAAGCCATCAACGAACAAAATATCTAGCAC
GGCATTAGGAGTGAAAGAGGGCCGGGAGGTGAAAAAGGTGAGAACTACGGGGAATAAGGCGC
GCACAACAACAAGCTCAAATGTGGGCCGTGTTGTTAGCGGCAACAATCGACGACACGCTGGG
GAGATCCATGACGGAGACAGCAAAGAATACCGTGGAACATCTTCAACATCAAATGGCTCTCA
GAACGCATCGTCTAAGCTCGCTATATCTGAGCGGACCAAATCGGTTGAAGCCTTGGCTTGGA
TTTTGGACTTGTTTTTCAAGATAGCCTCCGGCTATTTCTGTCTCAGCCGGTACAAATGCTCC
GATGCTATCCAGATTTTCAGCTCTCTATCCCAGGGCCAACGGGAGACACCGTGGGTTCTTGC
TCAAATTGGACGAGCTTACTACGAGCAAGCAATGTATACAGAGGCCGAGAAATACTTTGTCC
GGGTGAAGGCCATGGCGCCTTCCCGGTTAGAAGATATGGAGATCTACTCGACGGTTCTTTGG
CATTTGAAGAATGATGTCGAACTTGCTTACCTGGCCCATGAGTTAATGGATGTCGATCGCTT
ATCACCAGAAGCTTGGTGTGCTGTCGGTAACTCGTTCTCACACCAGCGGGACCACGATCAAG
CTCTGAAGTGCTTCAAGCGTGCCACTCAATTGGATCCTCATTTCGCGTATGGGTTCACGCTA
CAGGGCCATGAGTATGTTGCCAACGAGGAATATGACAAGGCATTGGATGCCTATAGAAGCGG
CATCAACGCGGACAGTCGACATTATAATGCCTGGTACGGGCTGGGAACGGTCTACGATAAGA
TGGGCAAACTTGACTTTGCTGAACAGCACTTCCGTAATGCGGCAAGATTAATCCTTCTAAT
GCTGTTTTAATATGCTGCATTGGCTTGGTCTTAGAGAAGATGAACAATCCGAAGTCAGCGTT
GATCCAGTACAACAGGGCCTGCACCCTCGCGCCTCATTCTGTTCTTGCTCGATTCCGAAAAG
CCCGTGCGTTGATGAAATTGCAGGATCTCAAGTCAGCGCTTACGGAGCTGAAGGTTCTGAAG
GACATGGCGCCGGATGAGGCAAACGTTCATTACCTCCTGGGCAAACTGTATAAGATGCTTCG
TGACAAGGGAAATGCCATTAAGCACTTCACAACTGCATTAAACCTTGATCCCAAGGCGGCGC
AGTACATCAAAGATGCAATGGAAGCCCTTGACGACGATGAAGAGGATGAAGAAGATATGGCG
TGA
```

SEQ ID NO : 142, Aspergillus niger bimA CDC27-like amino acid sequence
```
MTPSTSHISSQLRQLIYYHLDNNLARNALFLAGRLHAYEPRTSEASYLLALCYLQNGQVKAA
WETSKHFGSRGAHLGCSYVYAQACLDLGKYTDGINALERSKGQWTSRNHWNKHSETRRQHLP
DAAAVLCLQGKLWQAHKEHNKAVECYAAALKLNPFMWDAFLNLCETGVDLRVSNIYKMSPEL
YSMVSSAALEDVESQVLPPDGPLQTQVNPNPSLDPFTAGTTRSDSTSTHGSSALWEKLNGST
VSVASSGTGPHLPREGMETPGGQSSESDDPRVTNGNGTDVFEPPLAPAKKNRTIQTIGGDHP
MDPPPKMRPTGIRPRTRTKFESDEGHTERDAGMGHRLGDRKRTVSGQVAHPSVPHSTDQGVG
QRRSVRLFNQIKPSTNKISSTALGVKEGREVKKVRTTGNKARTTTSSNVGRVVSGNNRRHAG
EIHDGDSKEYRGTSSTSNGSQNASSKLAISERTKSVEALAWILDLFFKIASGYFCLSRYKCS
DAIQIFSSLSQGQRETPWVLAQIGRAYYEQAMYTEAEKYFVRVKAMAPSRLEDMEIYSTVLW
HLKNDVELAYLAHELMDVDRLSPEAWCAVGNSFSHQRDHDQALKCFKRATQLDPHFAYGFTL
QGHEYVANEEYDKALDAYRSGINADSRHYNAWYGLGTVYDKMGKLDFAEQHFRNAAKINPSN
AVLICCIGLVLEKMNNPKSALIQYNRACTLAPHSVLARFRKARALMKLQDLKSALTELKVLK
DMAPDEANVHYLLGKLYKMLRDKGNAIKHFTTALNLDPKAAQYIKDAMEALDDDEEDEEDMA
```

SEQ ID NO : 143, Homo sapiens CDC27 nucleic acid sequence NM_001256.2
```
ATGACGGTGCTGCAGGAACCCGTCCAGGCTGCTATATGGCAAGCACTAAACCACTATGCTTA
CCGAGATGCGGTTTTCCTCGCAGAACGCCTTTATGCAGAAGTACACTCAGAAGAAGCCTTGT
TTTTACTGGCAACCTGTTATTACCGCTCAGGAAAGGCATATAAAGCATATAGACTCTTGAAA
GGACACAGTTGTACTACACCGCAATGCAAATACCTGCTTGCAAAATGTTGTGTTGATCTCAG
```

FIGURE 20 (continued)

```
CAAGCTTGCAGAAGGGGAACAAATCTTATCTGGTGGAGTGTTTAATAAGCAGAAAAGCCATG
ATGATATTGTTACTGAGTTTGGTGATTCAGCTTGCTTTACTCTTTCATTGTTGGGACATGTA
TATTGCAAGACAGATCGGCTTGCCAAAGGATCAGAATGTTACCAAAAGAGCCTTAGTTTAAA
TCCTTTCCTCTGGTCTCCCTTTGAATCATTATGTGAAATAGGTGAAAAGCCAGATCCTGACC
AAACATTTAAATTCACATCTTTACAGAACTTTAGCAACTGTCTGCCCAACTCTTGCACAACA
CAAGTACCTAATCATAGTTTATCTCACAGACAGCCTGAGACAGTTCTTACGGAAACACCCCA
GGACACAATTGAATTAAACAGATTGAATTTAGAATCTTCCAATTCAAAGTACTCCTTGAATA
CAGATTCCTCAGTGTCTTATATTGATTCAGCTGTAATTTCACCTGATACTGTCCCACTGGGA
ACAGGAACTTCCATATTATCTAAACAGGTTCAAAATAAACCAAAAACTGGTCGAAGTTTATT
AGGAGGACCAGCAGCTCTTAGTCCATTAACCCCAAGTTTTGGGATTTTGCCATTAGAAACCC
CAAGTCCTGGAGATGGATCCTATTTACAAAACTACACTAATACACCTCCTGTAATTGATGTG
CCATCCACCGGAGCCCCTTCAAAAAAGTCTGTTGCCAGAATCGGCCAAACTGGAACAAAGTC
TGTCTTCTCACAGAGTGGAAATAGCCGAGAGGTAACTCCAATTCTTGCACAAACACAAAGTT
CTGGTCCACAAACAAGTACAACACCTCAGGTATTGAGCCCCACTATTACATCTCCCCCAAAC
GCACTACCTCGAAGAAGTTCACGACTCTTTACTAGTGACAGCTCCACAACCAAGGAGAATAG
CAAAAAATTAAAAATGAAGTTTCCACCTAAAATCCCAAACAGAAAAACAAAAAGTAAAACTA
ATAAAGGAGGAATAACTCAACCTAACATAAATGATAGCCTGGAAATTACAAAATTGGACTCT
TCCATCATTTCAGAAGGGAAAATATCCACAATCACACCTCAGATTCAGGCCTTTAATCTACA
AAAAGCAGCAGCAGGTTTGATGAGCCTTCTTCGTGAAATGGGGAAAGGTTATTTAGCTTTGT
GTTCATACAACTGCAAAGAAGCTATAAATATTTTGAGCCATCTACCTTCTCACCACTACAAT
ACTGGTTGGGTACTGTGCCAAATTGGAAGGGCCTATTTTGAACTTTCAGAGTACATGCAAGC
TGAAAGAATATTCTCAGAGGTTAGAAGGATTGAGAATTATAGAGTTGAAGGCATGGAGATCT
ACTCTACAACACTTTGGCATCTTCAAAAAGATGTTGCTCTTTCAGTTCTGTCAAAAGACTTA
ACAGACATGGATAAAAATTCGCCAGAGGCCTGGTGTGCTGCAGGGAACTGTTTCAGTCTGCA
ACGGGAACATGATATTGCAATTAAATTCTTCCAGAGAGCTATCCAAGTTGATCCAAATTACG
CTTATGCCTATACTCTATTAGGGCATGAGTTTGTCTTAACTGAAGAATTGGACAAAGCATTA
GCTTGTTTTCGAAATGCTATCAGAGTCAATCCTAGACATTATAATGCATGGTATGGTTTAGG
AATGATTTATTACAAGCAAGAAAAATTCAGCCTTGCAGAAATGCATTTCCAAAAAGCGCTTG
ATATCAACCCTCAAAGTTCAGTTTTACTTTGCCACATTGGAGTAGTTCAACATGCACTGAAA
AAATCAGAGAAGGCTTTGGATACCCTAAACAAAGCCATTGTCATTGATCCCAAGAACCCTCT
ATGCAAATTTCACAGAGCCTCAGTTTTATTTCGAAATGAAAAATATAAGTCTGCTTTACAAG
AACTTGAAGAATTGAAACAAATTGTTCCCAAAGAATCCCTCGTTTACTTCTTAATAGGAAAG
GTTTACAAGAAGTTAGGTCAAACGCACCTCGCCCTGATGAATTTCTCTTGGGCTATGGATTT
AGATCCTAAAGGAGCCAATAACCAGATTAAAGAGGCAATTGATAAGCGTTATCTTCCAGATG
ATGAGGAGCCAATAACCCAAGAAGAACAGATCATGGGAACAGATGAATCCCAGGAGAGCAGC
ATGACAGATGCGGATGACACACAACTTCATGCAGCTGAAAGTGATGAATTTTAA
```

SEQ ID NO : 144, Homo sapiens CDC27 amino acid sequence
MTVLQEPVQAAIWQALNHYAYRDAVFLAERLYAEVHSEEALFLLATCYYRSGKAYKAYRLLK
GHSCTTPQCKYLLAKCCVDLSKLAEGEQILSGGVFNKQKSHDDIVTEFGDSACFTLSLLGHV
YCKTDRLAKGSECYQKSLSLNPFLWSPFESLCEIGEKPDPDQTFKFTSLQNFSNCLPNSCTT
QVPNHSLSHRQPETVLTETPQDTIELNRLNLESSNSKYSLNTDSSVSYIDSAVISPDTVPLG
TGTSILSKQVQNKPKTGRSLLGGPAALSPLTPSFGILPLETPSPGDGSYLQNYTNTPPVIDV
PSTGAPSKKSVARIGQTGTKSVFSQSGNSREVTPILAQTQSSGPQTSTTPQVLSPTITSPPN
ALPRRSSRLFTSDSSTTKENSKKLKMKFPPKIPNRKTKSKTNKGGITQPNINDSLEITKLDS
SIISEGKISTITPQIQAFNLQKAAAAGLMSLLREMGKGYLALCSYNCKEAINILSHLPSHHY
NTGWVLCQIGRAYFELSEYMQERIFSEVRRIENYRVEGMEIYSTTLWHLQKDVALSVLSKD LTDMDKNSPEAWCAAGNCFSLQREHDIAIKFFQRAIQVDPNYAYAYTLLGHEFVLTEELDKA
LACFRNAIRVNPRHYNAWYGLGMIYYKQEKFSLAEMHFQKALDINPQSSVLLCHIGVVQHAL
KKSEKALDTLNKAIVIDPKNPLCKFHRASVLFANEKYKSALQELEELKQIVPKESLVYFLIG
KVYKKLGQTHLALMNFSWAMDLDPKGANNQIKEAIDKRYLPDDEEPITQEEQIMGTDESQES
SMTDADDTQLHAAESDEF SEQ ID NO : 145, Saccharum officinarum 5'CDC27 CA102186.1
CA279358.1 compiled ESTs
ATGGAAACCCTAATGGTGGACCGCGTCCACAGCAGCCTCCGCCTCTTCATGCACCGCAACGC
CGTATTCCTCTGCGAGCGCCTCTGCGCGCAGTTCCCCTCCGAGACCAATGTGCAATTGTTAG
CGACCTGCTACCTCCACAACAATCAGCCATATGCTGCATACCACATTTTGAAAGGGAAGAAG
CTGCCGGAGTCCCGGTACTTGTTTGCTACATCATGCTTTCGAATGAACCTCTTGCGTGAAGC
AGAAGAAACTCTATGTCCAGTCAATGAACCAAACATGGAGGTTCCAAGTGGAGCAACAGGAC
ACTACCTCCTTGGAGTGATTTACAGGTGCACAGGCAGAATTTCAGCTGCAGCTGAACAATTT
ACACAAGCGTTGACTCTAGATCCTCTTTTATGGGCGGCATATGAGGAATTGTGTATATTAGG
TATTGCTGAAGATACTGATGAGTGTTTTAGTGAATCGACTGCTCTACGTCTCCAGCAGGAAC
ACACATCCACGGCCACTCTGGTGAAGTCGAACTTCGCCAATGAAAATCGAGTTCTATCATCC
AGGGTCTCTGCAAATCTTGGGGATATTAGTCCTAAGCAAATCAAACAGCTTCATGCTAACAA
CATAGCAGAAGTATCTGGCTATCCTCATGTAAGACCAACTGCATTGCATGTGCAGAACAGTT
CAACCTCTAATGTAGCACAGTTTGACACCCCATCACCAACTGCAGCACAGACTTCTAGTATC
ATGCCACCACCACTCTTTAGGAATGTCCATGCTTANNNN SEQ ID NO : 146, Saccharum officinarum N-terminal CDC27
METLMVDRVHSSLRLFMHRNAVFLCERLCAQFPSETNVQLLATCYLHNNQPYAAYHILKGKK
LPESRYLFATSCFRMNLLREAEETLCPVNEPNMEVPSGATGHYLLGVIYRCTGRISAAAEQF
TQALTLDPLLWAAYEELCILGIAEDTDECFSESTALRLQQEHTSTATLVKSNFANENRVLSS
RVSANLGDISPKQIKQLHANNIAEVSGYPHVRPTALHVQNSSTSNVAQFDTPSPTAAQTSSI
MPPPLFRNVHA SEQ ID NO : 147, Saccharum officinarum 3'CDC27 CA197669.1
CA197670.1 CA203636.1 CA232307.1 compiled ESTs
ATTCAAATTCAAATACCTGGGGTTTGGAGGGAATGGTACAGGTTATTCGTCAGGGAAATTGC
GAGTAAACTCGTCCACACCATCAAAATGGTGTTAACCACCATACGTTCCGTGCAAGTTAGGA
AAGGAAAACCACGGGCTACAGAAAATTTTGATGAAGGAAGTAGATATGAAGTCATTGATGAA
ATGTGGACAGACAATATATCAGGAACTTCATCTTCTGTAAGTACAGCTGATGGAAGATCCTT
TGAGCAAGATAAAGCTGAACGAATTCTGTTGCAAGACTCCAAATTGGCACTTGGTATTAGGG
AGATATTGGACTTGTCCGAACACTCGGTGAAGGTTGTAGGCTTTCTTGCTTGTTTAAGTGC
CATGAAGCCTTGGAAGTCTACAGAAGACTCCCTGAGACCCATTNTAGCACTGGATGGAGCAT
ATGCCAGGTTGGTAAGGCATATTTCGAATTAGTTGATTATTTGGAAGCTGATCGTTACTTTG
AATTGGCACACCGACTGTCGCCTTGTACGCTTGATGGAATGGACATCTATTCTACTGTTCTT
TATCATCTGAATGAGGAAATGAGACTAAGCTACCTTGCTCAAGAGCTTATTTCCATTGATCG
ACTATCTCCTCAAGCATGGTGTGCAGTGGGCAATTGCTTTGCCTTGAGGAAAGATCATGAGA
CTGCTTTGAAGAATTTTCAACGTTCGGTACAGCTTGACTCAAGATTTGCATATGCTCACACT
CTATGTGGTCATGAGTATTCTGCATTGGAGGATTATGAGAATAGTATCAAATTCTACCGGTG
TGCACTGCAGGTAGATGAAAGGCACTACAATGCCTGGTATGGCCTTGGGGTGGTGTATCTTC
GCCAGGAAAAGTNTGAGTTTGCTGAGCATCATTTCAGAAGGGCATTTCAGATAAATCCTCGC
TCTTCTGTTCTCATGTGCTATCTTGGGATGGCGTTGCATTCTCTTAAGAGGAAGGAGGAGGC FIGURE 20 (continued)

ATTGGAAATGATGGAGAAAGCTATAGCAGCTGATAAGAAGAATCCACTGCCCAAGTATCAGA
AGGCCTTAATCCTTCTAGGTCTTCAGAAGTATCAAGAAGCTCTGGATGAGTTGGAGCGGCTA
AAGGAGATTGCACCTCATGAGAGCAGTATGTATGCACTGATGGGAAAGATTTACAAGCAACT
CAATATCCTTGACAAAGCTGTTTTCTGCTTTGGCATTGCCCTGGATTTGAAACCTCCTGCTG
CTGATCTTGCTATAATTAAGTCCGCAATGGAGAAAGTACATCTCCCTGATGAACTGATGGAG
GATGACCTGTAA

SEQ ID NO : 148, Saccharum officinarum C-terminal CDC27
IQIQIPGVWREWYRLFVREIASKLVHTIKMVLTTIRSVQVRKGKPRATENFDEGSRYEVIDE
MWTDNISGTSSSVSTADGRSFEQDKAERILLQDSKLALGIREILGLVRTLGEGCRLSCLFKC
HEALEVYRRLPETHXSTGWSICQVGKAYFELVDYLEADRYFELAHRLSPCTLDGMDIYSTVL
YHLNEEMRLSYLAQELISIDRLSPQAWCAVGNCFALRKDHETALKNFQRSVQLDSRFAYAHT
LCGHEYSALEDYENSIKFYRCALQVDERHYNAWYGLGVVYLRQEKXEFAEHHFRRAFQINPR
SSVLMCYLGMALHSLKRKEEALEMMEKAIAADKKNPLPKYQKALILLGLQKYQEALDELERL
KEIAPHESSMYALMGKIYKQLNILDKAVFCFGIALDLKPPAADLAIIKSAMEKVHLPDELME
DDL

SEQ ID NO : 149, prm00778
GGGGACAAGTTTGTACAAAAAAGCAGGCTTCACAATGCAACAACTGTCAACTTC

SEQ ID NO : 150, prm00779
GGGGACCACTTTGTACAAGAAAGCTGGGTTGGAGTAGCTATGGTTTCAC

SEQ ID NO : 151, Oryza sativa OSH1 promoter
GGGGAGTTAGGAACCTTGACATACAACCAATGATACCATTTTTTTTCAAGCAGCTAGAGGTA
CAGAGGTTCATATTTTTAGATGGCTCATTAGTGATATTTAGTCAAAAATTTCAGAAGTAC
GGCCACGGGTGATGGCCTGAACTAATATTTTATTCGAGGTGCCGCTACATCATCGTCTAAAG
TACACGCAAGATTCAACGGAAAAAGAAACCGATCGATCGAGATCAGTTAGTTAATGAAATA
ACTAGATCAACTCATGTCGTCAAAAACAAAAGATGCTCATCTATGGACAACACACGCTGATG
ATTCGATCATCAAACAAAGGTGGTAGTAGTAGTAAAGCGTATCGTGTTTCTCATCAGAAAGA
AGAATTAAAGAAAAAACTAATCCCGTCTCGCGAGCCAGAGAAAATTCCCTACAAAAGCCACT
CCTTTGATTTGACATGCAAAAGCAAGGCTCCACTCCTCTACTACCCTACAACTACACAACAC
TGTCTCTCTATCTCCAAAGGCAGTAGCTGTATTGGCTTCCAGCTTTTCCTCTCTACCTCTAA
TGATAGCTTGGAGCAAGTTCAATAGTATAGCTAACTACTAGCTCTAATTCATCTATAATCAA
TCTAATAGCTTATTCATACAATAGTTATATACTACATTATTAATATCTGGTCCCATCTATCA
TACACACTGAGTCTGTGCTATAGCTGACTACAAATCTGTAGCCCGCTGCTCTTCTCTCTTCA
TTTATCTTCTTAAAATATATTTGCAGCTGGCTTATGGCTTATAGCTTGATATTGAGAGGGAG
AGGAGTGAGAGCTAGCTCAGCTCAGCTCAAGGTAAACAACAAGGCACACTCTTCCTACCTCT
TCTCCGGTTCTTCCTTTTTCCTCTTTCTCTTCGTCCAAGAACTTCACCTCAATAGCTCGAGC
TACGGCCTAACTTTTGCGTTGCGCAGGAGAGCTCGATCGCTGCACCAATACTTCACTGGAGA
TCGCCTAGCTGCAGCTAGCTAGCTTATCCTGCGTGTCTTGAGCTTCTCTC

FIGURE 23

|  | 151 | 200 |
| --- | --- | --- |
| Os_NP_912386 (59) | KPPVVVTRESPNAMRSHVLEIASGADIVEAIAGFSRRRQRGVSVLSGSGA | |
| PROT_Os_AK110263 (49) | KPPIFVTRDSPNALRSHVMEVAGGALVAESIAHFARRRQRGVCVLSGAGT | |
| PROT_Os_AK107405 (125) | KPPVIITRDSASALRAHVLEVASGCDLVDSVATFARRRQVGVCVLSATGA | |
| PROT_Le_BT013387 (68) | KPPVIIIRESANALRAHILEVSSGHDVFESVATYARKRQRGICILSGSGT | |
| PROT_Lc_AP006863.1 (95) | KPPIIITRDSANALRTHVMEVADGCDIVESVSNFARRRQRGVCIMSGTGT | |
| PRO_Mt_TC102931 (100) | KPPIIITRDSANALRSHVMEVANGCDLMESVTVFARRRQRGVCILSGSGT | |
| Os_XP_473716 (96) | KPPVIITRESANTLRAHILEVGSGCDVFECVSTYARRRQRGVCVLSGSGV | |
| Os_CDS3129 (111) | KPPIIITRDSANTLRTHVMEVAGGCDISESITTFARRRQRGVCVLSGAGT | |
| Os_CDS3128 (96) | KPPVIITRESANTLRAHILEVGSGCDVFECVSTYARRRQRGVCVLSGSGV | |
| At_NP_567432 (81) | KAPIEVTRDSPNALRSHVLEISDGSLVADTIAHFSRRRQRGVCVLSGTGS | |
| At_NP_194012 (119) | KPPIIITRDSANALRTHVMEIGDGCDLVESVATFARRRQRGVCVMSGTGN | |
| At_NP_192942 (132) | KAPIIITRDSANALRTHVMEIGDGCDIVDCMATFARRRQRGVCVMSGTGS | |
| At_NP_191646 (73) | KAPIIVTRDSANAFRCHVMEITNACDVMESLAVFARRRQRGVCVIEGNGA | |
| At_NP_182067 (103) | KPPIIIIRDSANALKSHVMEVANGCDVMESVTVFARRRQRGICVLSGNGA | |
| AT_NP_181070 (92) | KPPIIVTRESANTLRAHILEVGSGCDVFECIQTYARRRQRGICVLSGTGT | |
| At_CDS4145 (96) | KPVIITRESANTLRAHILEVTNGCDVFDCVATYARRRQRGICVLSGSGT | |
| At_CDS3399 (94) | KPPIFVTRDSPNALKSHVMEIASGTDVIETIATFARRRQRGICQLSGNGT | |
| At_CDS3125 (48) | KPPETIIRDSPNVLRSHVLEVTSGSDESEAVSTYATRRGCGVCIISGTGA | |
| At_CDS0185 (102) | KSPVVVTKESPNSLQSHVLEIATGADVAESINAFARRRGRGVSVLSGSGL | |
| Consensus (151) | KPPIIITRDSANALRSHVLEVA_GCDV_ESVATFARRRQRGVCVLSGSGT | |

← DUF296

|  | 201 | 250 |
| --- | --- | --- |
| Os_NP_912386 (109) | VTNVTLRQP-----AGTGAA--AVARGRFETLSMSGAFLPAP-APPGAT | |
| PROT_Os_AK110263 (99) | VTDVALRQP-----AAPSA---VVARGRFEILSLTGTFLPGP-AEPGST | |
| PROT_Os_AK107405 (175) | VTNVSVRQ------PGAGP--GAVVNITGRFDILSLSGSFLPPP-APPSAT | |
| PROT_Le_BT013387 (118) | VNNVTIRQP--------QAAGSVVTIHGREEILSLAGSFLPPP-APPGAT | |
| PROT_Lc_AP006863.1 (145) | VTNVTLRQ------PASSG--AVVTIHGREEILSLAGSFLPPP-APPAAS | |
| PRO_Mt_TC102931 (150) | VTNVTLRQ------PASPG--AVVIHGRFEILSLSGSFLPPP-APPAAS | |
| Os_XP_473716 (146) | VTNVTLRQPS------APAGAVVSIHGREEILSLSGSFLPPP-APPGAT | |
| Os_CDS3129 (161) | VTNVTLRQ------PASQ---GAVVAIHGRFEILSLSGSFLPPP-APPEAT | |
| Os_CDS3128 (146) | VTNVTLRQPS-------APAGAVVSIHGREEILSLSGSFLPPP-APPGAT | |
| At_NP_567432 (131) | VANVTLRQ------AAAPG--GVVSIQGRFEILSLTGAFLPGP-SEPCST | |
| At_NP_194012 (169) | VTNVTIRQ------PGSHPSPGSVVSIHGRFEILSLSGSFLPPP-APPTAT | |
| At_NP_192942 (182) | VTNVTIRQ------PGSP---PGSVVSIHGRFEILSLSGSFLPPP-APPAAT | |
| At_NP_191646 (123) | VTNVTVRQ------PGGG------VVSIHGRFEILSLSGSFLPPP-APPAAS | |
| At_NP_182067 (153) | VTNVTIRQPASV--PGGGS---SVVNIHGRFEILSLSGSFLPPP-APPAAS | |
| AT_NP_181070 (142) | VTNVSIRQP--------TAAGAVVTIRGTEEILSLSGSFLPPP-APPGAT | |
| At_CDS4145 (146) | VTNVSIRQP--------SAAGAVVTIQGTEEILSLSGSFLPPP-APPGAT | |
| At_CDS3399 (144) | VANVTLRQPSTAAVAAAPGGAAVIAIQGRFEILSLTGSFLPGP-AEPGST | |
| At_CDS3125 (98) | VTNVTIRQPAAP-AGGG-----VITIHGRFDILSLTGTALPPP-AEPGAG | |
| At_CDS0185 (152) | VTNVTLRQP-----AASGG---VVSLRGQFEILSMCGAFLETSGSPAAAA | |
| Consensus (201) | VTNVTLRQP___AA___GAVVSLHGRFEILSLSGSFLPPP_APPGAT | |

DUF296

MOTIF 2

FIGURE 23 (continued)

```
                        251                                                300
     Os_NP_912386 (151) GLAVYLAGGQGQVVGGSVMGELIASGPVMVIAATFGNATYERLPLTQEG-
 PROT_Os_AK110263 (140) GLTMYLAGGQGQVVGGSVVGTLTAAGPVMVIASTFANATYERLBLLQE--
 PROT_Os_AK107405 (217) GLTVYVSGGQGQVVGGTVAGPLIAVGPVVIMAASFGNAAYERLBLEDDEP
 PROT_Le_BT013387 (159) SLTIYLAGGQGQVVGGNVVGALIASGPVIVIASSETANVAYERLBLDEENE
PROT_Lc_AP006863.1 (186) GLTIYLAGGQGQVVGGSVVGALIASGPVVIMAASFSNAAYERLBLEDEDP
   PRO_Mt_TC102931 (191) GLAIYLAGGQGQVVGGSVVGPLLASGPVVIMBASFGNAAYERLBLEDEET
       Os_XP_473716 (188) SLTIELAGGQGQVVGGNVVGALYAAGPVIVIAASFANVAYERLBLEEEEA
       Os_CDS3129 (202) GLTVYLAGGQGQVVGGSVVGALTAAGPVVIMAASFANAVYERLBLEDDEL
       Os_CDS3128 (188) SLTIELAGGQGQVVGGNVVGALYAAGPVIVIAASFANVAYERLBLEEEEA
     At_NP_567432 (172) GLTVYLAGVQGQVVGGSVVGPLLIAIGSVMVIAATFSNATYERLPMEEE--
     At_NP_194012 (213) GLSVYLAGGQGQVVGGSVVGPLLICAGPVVVMAASFSNAAYERLBLEEDEM
     At_NP_192942 (224) GLSVYLAGGQGQVVGGSVVGPLLCSGPVVVMAASFSNAAYERLBLEEDEM
     At_NP_191646 (162) GLKVYLAGGQGQVIGGSVVGPLTASSPVVVMAASFGNASYERLBLEEEEE
     At_NP_182067 (198) GLTIYLAGGQGQVVGGSVVGPLMASGPVVIMAASFGNAAYERLBLEEDDQ
     AT_NP_181070 (183) SLTIELAGAQGQVVGGNVVGELMAAGPVMVMAASFTNVAYERLBLDEHEE
       At_CDS4145 (187) SLTIELAGGQGQVVGGSVVGELTAAGPVIVIAASFTNVAYERLBLEEDEQ
       At_CDS3399 (193) GLTIYLAGGQGQVVGGSVVGPLMAAGPVMLIAATFSNATYERLBLEEEEA
       At_CDS3125 (141) GLTVYLAGGQGQVVGGNVAGSLIASGPVVIMAASFANAVYDRLPIEEEET
       At_CDS0185 (194) GHTIYLAGAQGQVVGGGVAGPLIASGPVIVIAATFCNATYERLPIEEEQ-
        Consensus (251) GLTIYLAGGQGQVVGGSVVG LIASGPVVVMAASFANAA ERLPLEEEE
                        └─────────DUF296─────────┘▶

301                                                350
     Os_NP_912386 (200) ---------EEGAVLS----GSEGAAAQMEQQS--SGG---------AVVP
 PROT_Os_AK110263 (188) ---------EEEAAAG--G-MMAPPPLMAGAADPLLFGGG----------
 PROT_Os_AK107405 (267) P--------QHMAGGG-----QSSPPPPPLPLPPEQQP------------
 PROT_Le_BT013387 (209) -----SIQMQQQGQ---------SG--NFADPSNIG--------------
PROT_Lc_AP006863.1 (236) S--------LAMQGGS-----MGSPPGGSGGGGGVGQQ-----QQQQLLG
   PRO_Mt_TC102931 (241) P--------VNVPG--------NGGLGSPGTMGSQQQQQ--QNQQQQQLVAD
       Os_XP_473716 (238) PPPQAGLQMQQPGGA-----DAGGMGGAFPPDPSAAG-------------
       Os_CDS3129 (252) L---------AAQGQAD-----SAGLLAAGQQAAQLAGG-----------
       Os_CDS3128 (238) PPPQAGLQMQQPGGA-----DAGGMGGAFPPDPSAAG-------------
     At_NP_567432 (220) ---------EDGGGSRQIHGGGDSPPRIGSNLPDLSGMAG----------
     At_NP_194012 (263) Q--------TPVHGGG-----GGGS----LESPPMMGQQ--------LQHQ
     At_NP_192942 (274) Q--------TPVQGGG-----GGGGGGGMGSPPMMGQ---------QQA
     At_NP_191646 (212) ---------------T-----EREIDGNAARAIGTQTQ--------KQLM
     At_NP_182067 (248) E--------EQTAGAV-----ANNIDGNATMGGGTQTQTQTQQQQQQQLM
     AT_NP_181070 (233) ---------HLQSGGGG-----GGGNMYSEATGGGGG-------------
       At_CDS4145 (237) ---------QQQLGGGS----NGGGNLFPEVAAGGGGG------------
       At_CDS3399 (243) A--------ERGGGGG---SGG-VVPGQLGGGGSPLSSGAGGG---DGNQG
       At_CDS3125 (191) P--------PPRTTGV-----QQQQP-EASQSSEVTGSGAQACESNLQGG
       At_CDS0185 (243) ---------QQEQPLQ----LEDGKKQKEENDDNESGNNGN----EGSMQ
        Consensus (301)                 GGG    GG   A         G 351                                                400
     Os_NP_912386 (227) PPMYAAVQQTPPHD------MFGQWGHAAVARPPP---TSF---------
 PROT_Os_AK110263 (216) -------------------MHDAGLAAWHHARPPPPPPY----------
 PROT_Os_AK107405 (292) ----ILQDHLPHNLMN--GIHLFGDAAYGWTSGGGGGGRAAPY-------
 PROT_Le_BT013387 (229) LPFLNLPLN-MPNGGG--QLQLESGGGEGWNGNTTNRPQY----------
PROT_Lc_AP006863.1 (268) DATAPLFHGLPPNLLN--SVQMPNSDNFWPSGRSPY--------------
   PRO_Mt_TC102931 (275) PNASSLFHGVPQNLLN--SCQLFAEGYWGGSARPPFLTKNVIHLITFLIM
       Os_XP_473716 (271) LPFFNLPLNNMPGGGG--SQLPPGADGHGWAG---ARPPF----------
       Os_CDS3129 (277) AVDPSLFQGIPPNLLG--NVQLPPEAAYGWNPGAGGGRPAPF--------
       Os_CDS3128 (271) LPFFNLPLNNMPGGGG--SQLPPGADGHGWAG---ARPPF----------
     At_NP_567432 (251) -PGYNMPPHLIPNGAG-----QLGHEPYTWVHARPPY-------------
     At_NP_194012 (289) QQAMSGHQGLPPNLLG--SVQLQ--QQHDQSYWSTGRPPY----------
     At_NP_192942 (302) MAAMAAAQGLPPNLLG--SVQLPPPQQNDQQYWSTGRPPY----------
     At_NP_191646 (234) QDATSFIG-SPSNLIN--SVSLPGEAYWG-TQRPSF--------------
     At_NP_182067 (285) QDPTSFIQGLPPNLMN--SVQLPAEAYWG-TPRPSF--------------
     AT_NP_181070 (256) LPFFNLPMSMP-------QIGVESWQGNHAGA---GRAPF----------
       At_CDS4145 (262) LPFFNLPMNMQPNV----QLPVEGWFGNSG-----GRGPF----------
       At_CDS3399 (279) LPVYNMPGNLVSNGGSGGGGQMSGQEAYGWAQARSGF-------------
       At_CDS3125 (227) NGGGGVAFYNLGMNMN--NFQFSGGDIYGMSGGSGGGGGATRPAF-----
       At_CDS0185 (276) PPMYNMPPNFIPNG------HQMAQHDVYWGGPPPRAPPSY---------
        Consensus (351)      L  LPPN     V LG       G         G
```

FIGURE 23 (continued)

```
         401
Os_NP_912386     (259) ---
PROT_Os_AK110263 (236) ---
PROT_Os_AK107405 (329) ---
PROT_Le_BT013387 (266) ---
PROT_Lc_AP006863.1 (302) ---
PRO_Mt_TC102931  (323) FFV
Os_XP_473716     (306) ---
Os_CDS3129       (317) ---
Os_CDS3128       (306) ---
At_NP_567432     (282) ---
At_NP_194012     (325) ---
At_NP_192942     (340) ---
At_NP_191646     (266) ---
At_NP_182067     (318) ---
AT_NP_181070     (286) ---
At_CDS4145       (293) ---
At_CDS3399       (316) ---
At_CDS3125       (271) ---
At_CDS0185       (311) ---
Consensus        (401)
```

FIGURE 23 (continued)

SEQ ID NO: 152, Oryza sativa – DNA sequence
ATGGATCCGGTCACGGCATCAATACACGGTCACCATCTTCCTCCACCGTTCAACACCCGCGA
CTTCCATCACCATCTCCAGCAGCAGCAGCACCAGCTGCATCTCAAGACCGAGGATGACCAAG
GCGGCGGCACTCCGGGTGTCTTCGGCAGCCGCGGCACCAAGCGCGACCACGACGACGACGAG
AACAGTGGCAACGGCCATGGAAGCGGTGGTGACGGCGGTGACCTCGCGCTGGTACCCCCCTC
GGGTGGCGGGCCGGACGGCGCCGGGAGCGAGAGCGCCACGCGCCGCCCGAGGGGACGCCCGG
CGGGGTCCAAGAACAAGCCGAAGCCACCGATCATCATCACCAGGGACAGCGCCAACACGCTC
CGGACGCATGTCATGGAGGTGGCCGGCGGCTGCGACATCTCCGAGAGCATCACCACGTTCGC
GCGACGCCGGCAGCGCGGGGTTTGCGTGCTCAGCGGCGCCGGCACCGTCACTAACGTCACGC
TGCGGCAGCCCGCATCGCAGGGAGCGGTCGTTGCGCTCCACGGCCGGTTCGAGATACTCTCC
CTCTCCGGCTCCTTCCTCCCGCCGCCCGCCCCGCCGGAGGCCACGGGGCTCACCGTCTACCT
GGCCGGAGGCCAGGGCCAGGTCGTGGGCGGCAGCGTCGTCGGCGCGCTGACCGCGGCTGGGC
CTGTGGTGATAATGGCGGCGTCTTTTGCGAACGCGGTGTACGAGCGGCTGCCGTTGGAGGAC
GACGAGCTACTGGCGGCTCAAGGGCAAGCCGACAGCGCTGGGTTGCTCGCCGCGGGGCAGCA
AGCGGCGCAGCTCGCCGGCGGGGCCGTCGATCCAAGCCTCTTCCAAGGACTACCACCAAACC
TACTCGGAAACGTGCAGCTGCCGCCGGAAGCCGCCTACGGATGGAACCCTGGCGCCGGCGGT
GGCCGCCCGGCGCCGTTCTGA

SEQ ID NO: 153, Oryza sativa – protein sequence
MDPVTASIHGHHLPPPFNTRDFHHHLQQQQHQLHLKTEDDQGGGTPGVFGSRGTKRDHDDDE
NSGNGHGSGGDGGDLALVPPSGGGPDGAGSESATRRPRGRPAGSKNKPKPPIIITRDSANTL
RTHVMEVAGGCDISESITTFARRRQRGVCVLSAGTVTNVTLRQPASQGAVVALHGRFEILS
LSGSFLPPPAPPEATGLTVYLAGGQGQVVGGSVVGALTAAGPVVIMAASFANAVYERLPLED
DELLAAQGQADSAGLLAAGQQAAQLAGGAVDPSLFQGLPPNLLGNVQLPPEAAYGWNPGAGG
GRPAPF

FIGURE 24

SEQ ID NO: 154, Oryza sativa - DNA sequence
ATGGCAGGTCTCGACCTCGGCACCGCCGCGACGCGCTACGTCCACCAGCTCCACCACCTCCA
CCCCGACCTCCAGCTGCAGCACAGCTACGCCAAGCAGCACGAGCCGTCCGACGACGACCCCA
ACGGCAGCGGCGGCGGCGGCAACAGCAACGGCGGGCCGTACGGGGACCATGACGGCGGGTCC
TCGTCGTCAGGCCCTGCCACCGACGGCGCGGTCGGCGGGCCCGGCGACGTGGTGGCGCGCCG
GCCGCGGGGGCGCCCGCCTGGCTCCAAGAACAAGCCGAAGCCGCCGGTGATCATCACGCGGG
AGAGCGCCAACACGCTGCGCGCCCACATCCTGGAGGTCGGGAGCGGCTGCGACGTGTTCGAG
TGCGTCTCCACGTACGCGCGCCGGCGGCAGCGCGGCGTGTGCGTGCTGAGCGGCAGCGGCGT
GGTCACCAACGTGACGCTGCGTCAGCCGTCGGCGCCCGCGGGCGCCGTCGTGTCGCTGCACG
GGAGGTTCGAGATCCTGTCGCTCTCGGGCTCCTTCCTCCCGCCGCCGGCTCCCCCCGGCGCC
ACCAGCCTCACCATCTTCCTCGCCGGGGGCCAGGGACAGGTCGTCGGCGGCAACGTCGTCGG
CGCGCTCTACGCCGCGGGCCCGGTCATCGTCATCGCGGCGTCCTTCGCCAACGTCGCCTACG
AGCGCCTCCCACTGGAGGAGGAGGAGGCGCCGCCGCCGCAGGCCGGCCTGCAGATGCAGCAG
CCCGGCGGCGGCGCCGATGCTGGTGGCATGGGTGGCGCGTTCCCGCCGGACCCGTCTGCCGC
CGGCCTCCCGTTCTTCAACCTGCCGCTCAACAACATGCCCGGTGGCGGCGGCTCACAGCTCC
CTCCCGGCGCCGACGGCCATGGCTGGGCCGGCGCACGGCCACCGTTCTGA

SEQ ID NO: 155, Oryza sativa - protein sequence
MAGLDLGTAATRYVHQLHHLHPDLQLQHSYAKQHEPSDDDPNGSGGGNSNGGPYGDHDGGS
SSSGPATDGAVGGPGDVVARRPRGRPPGSKNKPKPPVIITRESANTLRAHILEVGSGCDVFE
CVSTYARRRQRGVCVLSGSGVVTNVTLRQPSAPAGAVVSLHGRFEILSLSGSFLPPPAPPGA
TSLTIFLAGGQGQVVGGNVVGALYAAGPVIVIAASFANVAYERLPLEEEEAPPPQAGLQMQQ
PGGGADAGGMGGAFPPDPSAAGLPFFNLPLNNMPGGGGSQLPPGADGHGWAGARPPF

SEQ ID NO: 156, Lotus corniculatus - DNA sequence
ATGGATCCATTATCAGCACACGGCCACTCTCTTCCTCCTCCTTTTCTCCATCTGCACCACCA
ACACCAACACCAGCAGCAGCATCAGCAGCATCAGTTCCACTCTTTACAGCAGCAGCAAACCC
CAGCAGAAGATGAACAGAGTGGAAGCAGCGGCGGCATCAAAAGGGAACGCGATGAAAACAAC
AACAGCCATGACGGCAAGAAGGCTCCGGAGGCGGAGGCGAAAGCGAGAATTCAAGAAGACC
TCGAGGAAGGCCCGCCGGATCGAAGAACAAGCCTAAGCCGCCCATCATCATCACCCGCGACA
GCGCCAACGCACTTAAGACCCACGTCATGGAGGTCGCCGACGGCTGCGACATCGTCGACAGC
GTCTCCAACTTTGCAAGACGCCGCCAGCGCGGCGTCTGCATCATGAGCGGCACTGGAACCGT
CACCAACGTCACTCTCAGGCAGCCAGCTTCTTCCGGCGCTGTTGTCACCCTCCACGGAAGGT
TTGAGATTCTCTCCCTGGCAGGATCGTTCCTGCCGCCGCCTGCTCCACCGGCAGCATCAGGT
TTGACCATTTACTTGGCTGGTGGACAAGGGCAGGTTGTTGGAGGAAGTGTTGTGGGAGCTCT
CATTGCTTCGGGACCTGTGGTTATCATGGCAGCTTCGTTCAGCAACGCTGCGTATGAGAGGC
TTCCTTTGGAAGATGAGGACCCTTCATTGGCAATGCAAGGAGGTTCAATGGGTTCACCACCC
GGTGGTAGTGGTGGTGGTGGTGGAGTTGGTCAGCAACAGCAGCAACAGCTTTTAGGGGATGC
AACTGCCCCACTTTTTCATGGTTTGCCTCCGAATCTTCTCAATTCTGTTCAGATGCCAAACT
CCGATAACTTCTGGCCATCTGGCCGCTCTCCTTACTGA

SEQ ID NO: 157, Lotus corniculatus - protein sequence
MDPLSAHGHSLPPPFLHLHHQHQHQQQHQQHQFHSLQQQQTPAEDEQSGSSGGIKRERDENN
NSHDGKEGSGGGGESENSRRPRGRPAGSKNKPKPPIIITRDSANALKTHVMEVADGCDIVDS
VSNFARRRQRGVCIMSGTGTVTNVTLRQPASSGAVVTLHGRFEILSLAGSFLPPPAPPAASG
LTIYLAGGQGQVVGGSVVGALIASGPVVIMAASFSNAAYERLPLEDEDPSLAMQGGSMGSPP
GGSGGGGVGQQQQQQLLGDATAPLFHGLPPNLLNSVQMPNSDNFWPSGRSPY

FIGURE 24 (continued)

SEQ ID NO: 158, Arabidopsis thaliana - DNA sequence
ATGGATCCAGTTCAATCTCATGGATCACAAAGCTCTCTTCCTCCTCCTTTCCATGCTAGAGA
TTTCCAATTACATCTTCAACAACAACAACAACATCAACAACAACATCAACAACAACAACAAC
AACAGTTCTTTCTCCACCATCATCAGCAACCACAAAGAAACCTTGATCAAGATCACGAGCAG
CAAGGAGGGTCAATATTGAATAGATCTATCAAGATGGATCGCGAAGAGACAAGCGATAACAT
GGACAACATCGCTAATACCAACAGCGGTAGCGAAGGTAAAGAGATGAGTTTACACGGAGGAG
AAGGAGGAAGCGGTGGTGGAGGAAGTGGAGAACAGATGACAAGAAGGCCAAGAGGAAGACCA
GCAGGATCCAAGAACAAACCTAAAGCTCCAATAATCATAACAAGAGACAGCGCAAACGCGCT
TCGAACTCACGTCATGGAGATAGGAGACGGATGTGACATAGTTGACTGTATGGCTACGTTCG
CTAGACGCCGCCAAAGAGGCGTTTGCGTTATGAGCGGTACAGGAAGCGTTACTAACGTCACT
ATACGTCAGCCTGGATCGCCACCTGGCTCGGTGGTTAGCCTTCACGGCCGGTTTGAAATCCT
CTCTCTTTCGGGATCTTTCTTGCCTCCGCCTGCGCCGCCTGCAGCCACCGGACTAAGCGTTT
ACCTAGCCGGAGGACAAGGGCAGGTCGTTGGAGGTAGTGTGGTGGGACCTTTGTTGTGTTCG
GGTCCTGTGGTGGTTATGGCGGCTTCTTTTAGCAATGCGGCGTACGAAAGGCTGCCTTTGGA
AGAAGATGAGATGCAGACGCCAGTTCAAGGAGGCGGTGGAGGAGGAGGAGGTGGTGGTGGAA
TGGGATCTCCCCCGATGATGGGACAGCAACAAGCTATGGCAGCTATGGCGGCGGCTCAAGGA
CTACCACCGAATCTTCTTGGTTCGGTTCAGTTGCCACCGCCACAACAGAATGATCAGCAGTA
TTGGTCTACGGGTCGGCCACCGTATTGA

SEQ ID NO: 159, Arabidopsis thaliana - protein sequence
MDPVQSHGSQSSLPPPFHARDFQLHLQQQQQHQQQHQQQQQQQFFLHHHQQPQRNLDQDHEQ
QGGSILNRSIKMDREETSDNMDNIANTNSGSEGKEMSLHGGEGGSGGGGSGEQMTRRPRGRP
AGSKNKPKAPIIITRDSANALRTHVMEIGDGCDIVDCMATFARRQRGVCVMSGTGSVTNVT
IRQPGSPPGSVVSLHGRFEILSLSGSFLPPPAPPAATGLSVYLAGGQGQVVGGSVVGPLLCS
GPVVVMAASFSNAAYERLPLEEDEMQTPVQGGGGGGGGGGMGSPPMMGQQQAMAAMAAAQG
LPPNLLGSVQLPPPQQNDQQYWSTGRPPY

SEQ ID NO: 160, Arabidopsis thaliana - DNA sequence
ATGGATCCAGTACAATCTCATGGATCACAAAGCTCTCTACCTCCTCCTTTCCACGCAAGAGA
CTTTCAATTACATCTTCAACAACAGCAACAAGAGTTCTTCCTCCACCATCACCAGCAACAAA
GAAACCAAACCGATGGTGACCAACAAGGAGGATCAGGAGGAAACCGACAAATCAAGATGGAT
CGTGAAGAGACAAGCGACAACATAGACAACATAGCTAACAACAGCGGTAGTGAAGGTAAAGA
CATAGATATACACGGTGGTTCAGGAGAAGGAGGTGGTGGCTCCGGAGGAGATCATCAGATGA
CAAGAAGACCAAGAGGAAGACCAGCGGGATCCAAGAACAAACCAAAACCACCGATTATCATC
ACACGGGACAGCGCAAACGCGCTTAGAACCCACGTGATGGAGATCGGAGATGGCTGCGACTT
AGTCGAAAGCGTTGCCACTTTTGCACGAAGACGCCAACGCGGCGTTTGCGTTATGAGCGGTA
CTGGAAATGTTACTAACGTCACTATACGTCAGCCTGGATCTCATCCTTCTCCTGGCTCGGTA
GTTAGTCTTCACGGAAGGTTCGAGATTCTATCTCTCTCAGGATCTTTTCTCCCTCCTCCGGC
TCCTCCTACAGCCACCGGATTGAGTGTTTACCTCGCTGGAGGACAAGGACAGGTGGTTGGAG
GAAGCGTAGTTGGTCCGTTGTTATGTGCTGGTCCTGTCGTTGTCATGGCTGCGTCTTTTAGC
AATGCGGCGTACGAAAGGTTGCCTTTAGAGGAAGATGAGATGCAGACGCCGGTTCATGGCGG
AGGAGGAGGAGGATCATTGGAGTCGCCGCCAATGATGGGACAACAACTGCAACATCAGCAAC
AAGCTATGTCAGGTCATCAAGGGTTACCACCTAATCTTCTTGGTTCGGTTCAGTTGCAGCAG
CAACATGATCAGTCTTATTGGTCAACGGGACGACCACCGTATTGA

SEQ ID NO: 161, Arabidopsis thaliana - protein sequence
MDPVQSHGSQSSLPPPFHARDFQLHLQQQQQEFFLHHHQQQRNQTDGDQQGGSGGNRQIKMD
REETSDNIDNIANNSGSEGKDIDIHGGSGEGGGGSGGDHQMTRRPRGRPAGSKNKPKPPIII
TRDSANALRTHVMEIGDGCDLVESVATFARRRQRGVCVMSGTGNVTNVTIRQPGSHPSPGSV
VSLHGRFEILSLSGSFLPPPAPPTATGLSVYLAGGQGQVVGGSVVGPLLCAGPVVVMAASFS
NAAYERLPLEEDEMQTPVHGGGGGGSLESPPMMGQQLQHQQQAMSGHQGLPPNLLGSVQLQQ
QHDQSYWSTGRPPY

SEQ ID NO: 162, Arabidopsis thaliana - DNA sequence
ATGGATCAGGTCTCTCGCTCTCTTCCTCCACCTTTTCTCTCAAGAGATCTCCATCTTCACCC
ACACCATCAATTCCAGCATCAGCAGCAGCAGCAGCAACAGAATCACGGCCACGATATAGACC
AGCACCGAATCGGTGGGCTAAAACGTGACCGAGATGCTGATATCGATCCCAACGAGCACTCT
TCAGCCGGAAAAGATCAAAGTACTCCTGGCTCCGGTGGAGAAAGCGGCGGCGGAGGAGGAGG
AGATAATCACATCACGAGAAGGCCACGTGGCAGACCAGCGGGATCTAAGAACAAACCAAAAC
CGCCAATCATCATCACTCGAGACAGCGCAAACGCTCTCAAATCTCATGTCATGGAAGTAGCA
AACGGATGTGACGTCATGGAAAGTGTCACCGTCTTCGCTCGCCGTCGCCAACGTGGCATCTG
CGTTTTGAGCGGAAACGGCGCCGTTACCAACGTTACCATAAGACAACCAGCTTCAGTACCTG
GTGGTGGCTCATCTGTCGTTAACTTACACGGACGTTTCGAGATTCTTTCTCTCGGGATCA
TTCCTTCCTCCTCCGGCTCCACCAGCTGCGTCAGGTCTAACGATTTACTTAGCCGGTGGTCA
GGGACAGGTTGTTGGAGGAAGCGTGGTTGGTCCACTCATGGCTTCAGGACCTGTAGTGATTA
TGGCAGCTTCGTTTGGAAACGCTGCGTATGAGAGACTGCCGTTGGAGGAAGACGATCAAGAA
GAGCAAACAGCTGGAGCGGTTGCTAATAATATCGATGGAAACGCAACAATGGGTGGTGGAAC
GCAAACGCAAACTCAGACGCAGCAGCAACAGCAACAACAGTTGATGCAAGATCCGACGTCGT
TTATACAAGGGTTGCCTCCGAATCTTATGAATTCTGTTCAATTGCCAGCTGAAGCTTATTGG
GGAACTCCGAGACCATCTTTCTAA

SEQ ID NO: 163, Arabidopsis thaliana - protein sequence
MDQVSRSLPPPFLSRDLHLHPHHQFQHQQQQQQQNHGHDIDQHRIGGLKRDRDADIDPNEHS
SAGKDQSTPGSGGESGGGGGGDNHITRRPRGRPAGSKNKPKPPIIITRDSANALKSHVMEVA
NGCDVMESVTVFARRRQRGICVLSGNGAVTNVTIRQPASVPGGGSSVVNLHGRFEILSLSGS
FLPPPAPPAASGLTIYLAGGQGQVVGGSVVGPLMASGPVVIMAASFGNAAYERLPLEEDDQE
EQTAGAVANNIDGNATMGGGTQTQTQTQQQQQQQLMQDPTSFIQGLPPNLMNSVQLPAEAYW
GTPRPSF

SEQ ID NO: 164, Arabidopsis thaliana - DNA sequence
ATGGATGAGGTATCTCGTTCTCATACACCGCAATTTCTATCAAGTGATCATCAGCACTATCA
CCATCAAAACGCTGGACGACAAAAACGCGGCAGAGAAGAAGAAGGAGTTGAACCCAACAATA
TAGGGGAAGACCTAGCCACCTTTCCTTCCGGAGAAGAGAATATCAAGAAGAGAAGGCCACGT
GGCAGACCTGCTGGTTCCAAGAACAAACCCAAAGCACCAATCATAGTCACTCGCGACTCCGC
GAACGCCTTCAGATGTCACGTCATGGAGATAACCAACGCCTGCGATGTAATGGAAAGCCTAG
CCGTCTTCGCTAGACGCCGTCAGCGTGGCGTTTGCGTCTTGACCGGAAACGGGCCGTTACA
AACGTCACCGTTAGACAACCTGGCGGAGGCGTCGTCAGTTTACACGGACGGTTTGAGATTCT
TTCTCTCTCGGGTTCGTTTCTTCCTCCACCGGCACCACCAGCTGCGTCTGGTTTAAAGGTTT
ACTTAGCCGGTGGTCAAGGTCAAGTGATCGGAGGCAGTGTGGTGGGACCGCTTACGGCATCA
AGTCCGGTGGTCGTTATGGCAGCTTCATTTGGAAACGCATCTTACGAGAGGCTGCCACTAGA
GGAGGAGGAGGAAACTGAAAGAGAAATAGATGGAAACGCGGCTAGGGCGATTGGAACGCAAA
CGCAGAAACAGTTAATGCAAGATGCGACATCGTTTATTGGGTCGCCGTCGAATTTAATTAAC
TCTGTTTCGTTGCCAGGTGAAGCTTATTGGGGAACGCAACGACCGTCTTTCTAA

SEQ ID NO: 165, Arabidopsis thaliana - protein sequence
MDEVSRSHTPQFLSSDHQHYHHQNAGRQKRGREEEGVEPNNIGEDLATFPSGEENIKKRRPR
GRPAGSKNKPKAPIIVTRDSANAFRCHVMEITNACDVMESLAVFARRRQRGVCVLTGNGAVT
NVTVRQPGGGVVSLHGRFEILSLSGSFLPPPAPPAASGLKVYLAGGQGQVIGGSVVGPLTAS
SPVVVMAASFGNASYERLPLEEEEETEREIDGNAARAIGTQTQKQLMQDATSFIGSPSNLIN
SVSLPGEAYWGTQRPSF

SEQ ID NO: 166, Arabidopsis thaliana - DNA sequence
ATGGCGAATCCTTGGTGGGTAGGGAATGTTGCGATCGGTGGAGTTGAGAGTCCAGTGACGTC
ATCAGCTCCTTCTTTGCACCACAGAAACAGTAACAACAACAACCCACCGACTATGACTCGTT
CGGATCCAAGATTGGACCATGACTTCACCACCAACAACAGTGGAAGCCCTAATACCCAGACT
CAGAGCCAAGAAGAACAGAACAGCAGAGACGAGCAACCAGCTGTTGAACCCGGATCCGGATC
CGGGTCTACGGGTCGTCGTCCTAGAGGTAGACCTCCTGGTTCCAAGAACAAACCAAAGAGTC
CAGTTGTTGTTACCAAAGAAAGCCCTAACTCTCTCCAGAGCCATGTTCTTGAGATTGCTACG
GGAGCTGACGTGGCGGAAAGCTTAAACGCCTTTGCTCGTAGACGCGGCCGGGGCGTTTCGGT
GCTGAGCGGTAGTGGTTTGGTTACTAATGTTACTCTGCGTCAGCCTGCTGCATCCGGTGGAG
TTGTTAGTTTACGTGGTCAGTTTGAGATCTTGTCTATGTGTGGGCTTTTCTTCCTACGTCT
GGCTCTCCTGCTGCAGCCGCTGGTTTAACCATTTACTTAGCTGGAGCTCAAGGTCAAGTTGT
GGGAGGTGGAGTTGCTGGCCCGCTTATTGCCTCTGGACCCGTTATTGTGATAGCTGCTACGT
TTTGCAATGCCACTTATGAGAGGTTACCGATTGAGGAAGAACAACAGCAAGAGCAGCCGCTT
CAACTAGAAGATGGGAAGAAGCAGAAAGAAGAGAATGATGATAACGAGAGTGGGAATAACGG
AAACGAAGGATCGATGCAGCCGCCGATGTATAATATGCCTCCTAATTTTATCCCAAATGGTC
ATCAAATGGCTCAACACGACGTGTATTGGGGTGGTCCTCCGCCTCGTGCTCCTCCTTCGTAT
TGA

SEQ ID NO: 167, Arabidopsis thaliana - protein sequence
MANPWWVGNVAIGGVESPVTSSAPSLHHRNSNNNNPPTMTRSDPRLDHDFTTNNSGSPNTQT
QSQEEQNSRDEQPAVEPGSGSGSTGRRPRGRPPGSKNKPKSPVVVTKESPNSLQSHVLEIAT
GADVAESLNAFARRRGRGVSVLSGSGLVTNVTLRQPAASGGVVSLRGQFEILSMCGAFLPTS
GSPAAAAGLTIYLAGAQGQVVGGVAGPLIASGPVIVIAATFCNATYERLPIEEEQQQEQPL
QLEDGKKQKEENDDNESGNNGNEGSMQPPMYNMPPNFIPNGHQMAQHDVYWGGPPPRAPPSY

SEQ ID NO: 168, Oryza sativa - DNA sequence
ATGGATCCGGTGACGGCGGCGGCGGCGCATGGGGGTGGGCACCACCACCACCACCACTTCGG
AGCGCCACCGGTGGCGGCGTTCCACCACCACCCGTTCCACCACGGCGGCGGGGCGCACTACC
CGGCGGCGTTCCAGCAGTTTCAGGAGGAGCAGCAGCAGCTTGTGGCGGCGGCGGCGGCGGCT
GGTGGGATGGCGAAGCAGGAGCTGGTGGATGAGAGCAACAACACCATCAACAGCGGCGGGAG
CAACGGGAGCGGCGGGGAGGAGCAGAGGCAGCAGTCCGGGGAGGAGCAGCACCAGCAAGGGG
CGGCGGCGCCGGTGGTGATCCGGCGTCCCAGGGGCCGCCCCGCCGGCTCCAAGAACAAGCCC
AAGCCTCCGGTCATCATCACGCGCGACAGCGCCAGCGCGCTGCGGGCGCACGTCCTCGAGGT
CGCCTCCGGGTGCGACCTCGTCGACAGCGTCGCCACGTTCGCGCGCCGCCGCCAGGTCGGTG
TCTGCGTGCTCAGCGCCACCGGCGCCGTCACCAACGTCTCCGTCCGGCAGCCCGGCGCGGGC
CCCGGCGCCGTCGTCAACCTCACCGGCCGCTTCGACATCCTCTCGCTGTCCGGCTCCTTCCT
CCCGCCGCCGGCGCCTCCCTCCGCCACCGGCCTCACCGTCTACGTCTCCGGCGGCCAGGGGC
AGGTCGTGGGCGGCACGGTCGCCGGACCGCTCATCGCCGTCGGCCCCGTCGTCATCATGGCC
GCCTCGTTCGGGAACGCCGCCTACGAGCGCCTCCCGCTCGAGGACGACGAGCCGCCGCAGCA
CATGGCGGGCGGCGGCCAGTCCTCGCCGCCGCCGCCGCCGCTGCCATTACCACCACACCAGC
AGCCGATTCTTCAAGACCATCTGCCACACAACCTGATGAACGGAATCCACCTCCCCGGCGAC
GCCGCCTACGGCTGGACCAGCGGCGGCGGCGGCGGCGGCCGCGCGGCGCCGTACTGA FIGURE 24 (continued)

SEQ ID NO: 169, Oryza sativa - protein sequence
MDPVTAAAAHGGGHHHHHHFGAPPVAAFHHHPFHHGGGAHYPAAFQQFQEEQQQLVAAAAAA
GGMAKQELVDESNNTINSGGSNGSGGEEQRQQSGEEQHQQGAAAPVVIRRPRGRPAGSKNKP
KPPVIITRDSASALRAHVLEVASGCDLVDSVATFARRRQVGVCVLSATGAVTNVSVRQPGAG
PGAVVNLTGRFDILSLSGSFLPPPAPPSATGLTVYVSGGQGQVVGGTVAGPLIAVGPVVIMA
ASFGNAAYERLPLEDDEPPQHMAGGGQSSPPPPPLPLPPHQQPILQDHLPHNLMNGIHLPGD
AAYGWTSGGGGGGRAAPY

SEQ ID NO: 170, Oryza sativa - DNA sequence
ATGGGGAGCATCGACGGCCACTCGCTGCAGCAGCATCAGGGGTACTCCCACGGCGGCGGCGC
GGGAGGGAGCAACGAGGAGGAGGAGGCGTCGCCGCCGCCCGGCGGTGGCTCGGCTACGGGGT
CGGCGGGCCGCCGGCCGAGGGGGAGGCCGCCGGGCTCCAAGAACAAGCCGAAGCCGCCCGTC
GTGGTGACGCGGGAGAGCCCCAACGCGATGCGTTCCCACGTGCTGGAGATCGCCAGCGGCGC
CGACATCGTCGAGGCCATCGCGGGCTTCTCCCGCCGCAGGCAGCGCGGCGTCTCCGTGCTCA
GCGGGAGCGGCGCCGTCACCAACGTCACGCTCCGGCAGCCCGCGGGGACTGGGGCCGCCGCC
GTCGCGCTGCGGGGGAGGTTCGAGATATTGTCCATGTCTGGCGCCTTCCTCCCGGCGCCGGC
GCCGCCAGGGGCCACGGGGCTCGCCGTGTACCTCGCCGGCGGGCAGGGCAGGTGGTGGGTG
GGAGCGTCATGGGGGAGCTGATCGCGTCGGGCCCCGTCATGGTGATCGCGGCCACGTTCGGC
AACGCCACGTACGAGAGGCTGCCGCTGGACCAGGAAGGCGAGGAGGGCGCCGTGCTGTCCGG
GTCGGAGGGCGCCGCCGCGCAGATGGAGCAGCAGAGCAGCGGAGGCGCCGTCGTGCCCCCGC
CGATGTACGCCGCCGTCCAGCAGACGCCGCCGCACGACATGTTCGGGCAGTGGGGGCATGCA
GCGGTGGCTCGGCCGCCGCCGACATCGTTCTAG

SEQ ID NO: 171, Oryza sativa - protein sequence
MGSIDGHSLQQHQGYSHGGGAGGSNEEEEASPPPGGGSATGSAGRRPRGRPPGSKNKPKPPV
VVTRESPNAMRSHVLEIASGADIVEAIAGFSRRRQRGVSVLSGSGAVTNVTLRQPAGTGAAA
VALRGRFEILSMSGAFLPAPAPPGATGLAVYLAGGQGQVVGGSVMGELIASGPVMVIAATFG
NATYERLPLDQEGEEGAVLSGSEGAAAQMEQQSSGGAVVPPPMYAAVQQTPPHDMFGQWGHA
AVARPPPTSF

SEQ ID NO: 172, Lycopersicon esculentum - DNA sequence
ATGGCTGGTTTGGACTTAGGTTCCGCTTCTCATCATCGTTTTCTCCCTCGTCATCTCCACGA
TCCTCAAGACGATGAAATCAATCGCAACAACACTCAATTTTCCGATGATGACAACAACAACA
ACGATAACAATAACAATAATAGCCCCGGGGTAGCACGTAGACCTAGAGGTCGTCCCGCGGGG
TCCAAAAATAAGCCTAAGCCTCCCGTGATCATAACACGGGAGAGCGCTAACGCGCTCCGTGC
GCATATTTTAGAAGTGAGTAGCGGACATGATGTCTTTGAATCAGTTGCTACTTATGCTAGAA
AAAGACAAAGAGGAATTTGCATACTGAGCGGGAGCGGTACGGTGAATAACGTCACCATACGG
CAGCCACAGGCTGCCGGTTCTGTGGTGACGTTACACGGAAGATTCGAGATATTATCTTTATC
CGGATCTTTCCTACCACCACCCGCTCCCCCTGGGGCCACCAGCTTAACGATTTATTTAGCGG
GTGGTCAAGGTCAAGTTGTTGGTGGAACGTTGTGGGTGCGCTAATTGCATCAGGACCGGTT
ATTGTTATTGCTTCGTCATTTACTAATGTTGCTTATGAGAGATTGCCTTTGGATGAAGAAAA
TGAGTCAATTCAGATGCAGCAACAAGGACAAAGTGGTAATTTTGCTGATCCATCTAATATTG
GATTACCTTTTCTTAATTTGCCATTAAACATGCCAAATGGTGGTGGTCAACTACAATTGGAA
AGTGGAGGAGGTGAAGGTTGGAATGGAAACACAACAAACAGGCCACAATATTAG

FIGURE 24 (continued)

SEQ ID NO: 173, Lycopersicon esculentum - protein sequence
MAGLDLGSASHHRFLPRHLHDPQDDEINRNNTQFSDDDNNNNDNNNNNSPGVARRPRGRPAG
SKNKPKPPVIITRESANALRAHILEVSSGHDVFESVATYARKRQRGICILSGSGTVNNVTIR
QPQAAGSVVTLHGRFEILSLSGSFLPPPAPPGATSLTIYLAGGQGQVVGGNVVGALIASGPV
IVIASSFTNVAYERLPLDEENESIQMQQQGQSGNFADPSNIGLPFLNLPLNMPNGGGQLQLE
SGGGEGWNGNTTNRPQY

SEQ ID NO: 174, Arabidopsis thaliana - DNA sequence
ATGGAACTTAACAGATCTGAAGCAGACGAAGCAAAGGCCGAGACCACTCCCACCGGTGGAGC
CACCAGCTCAGCCACAGCCTCTGGCTCTTCCTCCGGACGTCGTCCACGTGGTCGTCCTGCAG
GTTCCAAAAACAAACCCAAACCTCCGACGATTATAACTAGAGATAGTCCTAACGTCCTTAGA
TCACACGTTCTTGAAGTCACCTCCGGTTCGGACATATCCGAGGCAGTCTCCACCTACGCCAC
TCGTCGCGGCTGCGGCGTTTGCATTATAAGCGGCACGGGTGCGGTCACTAACGTCACGATAC
GGCAACCTGCGGCTCCGGCTGGTGGAGGTGTGATTACCCTGCATGGTCGGTTTGACATTTTG
TCTTTGACCGGTACTGCGCTTCCACCGCCTGCACCACCGGGAGCAGGAGGTTTGACGGTGTA
TCTAGCCGGAGGTCAAGGACAAGTTGTAGGAGGGAATGTGGCTGGTTCGTTAATTGCTTCGG
GACCGGTAGTGTTGATGGCTGCTTCTTTTGCAAACGCAGTTTATGATAGGTTACCGATTGAA
GAGGAAGAAACCCCACCGCCGAGAACCACCGGGGTGCAGCAGCAGCAGCCGGAGGCGTCTCA
GTCGTCGGAGGTTACGGGGAGTGGGGCCCAGGCGTGTGAGTCAAACCTCCAAGGTGGAAATG
GTGGAGGAGGTGTTGCTTTCTACAATCTTGGAATGAATATGAACAATTTTCAATTCTCCGGG
GGAGATATTTACGGTATGAGCGGCGGTAGCGGAGGAGGTGGTGGCGGTGCGACTAGACCCGC
GTTTTAG

SEQ ID NO: 175, Arabidopsis thaliana - protein sequence
MELNRSEADEAKAETTPTGGATSSATASGSSSGRRPRGRPAGSKNKPKPPTIITRDSPNVLR
SHVLEVTSGSDISEAVSTYATRRGCGVCIISGTGAVTNVTIRQPAAPAGGGVITLHGRFDIL
SLTGTALPPPAPPGAGGLTVYLAGGQGQVVGGNVAGSLIASGPVVLMAASFANAVYDRLPIE
EEETPPPRTTGVQQQQPEASQSSEVTGSGAQACESNLQGGNGGGGVAFYNLGMNMNNFQFSG
GDIYGMSGGSGGGGGATRPAF

SEQ ID NO: 176, Arabidopsis thaliana - DNA sequence
ATGGCGAATCCATGGTGGACAGGACAAGTGAACCTATCCGGCCTCGAAACGACGCCGCCTGG
TTCCTCTCAGTTAAAGAAACCAGATCTCCACATCTCCATGAACATGGCCATGGACTCAGGTC
ACAATAATCATCACCATCACCAAGAAGTCGATAACAACAACAACGACGACGATAGAGACAAC
TTGAGTGGAGACGACCACGAGCCACGTGAAGGAGCCGTAGAAGCCCCACGCGCCGTCCACG
TGGACGTCCTGCTGGTTCCAAGAACAAACCAAAGCCACCGATCTTCGTCACTCGCGATTCTC
CAAATGCTCTCAAGAGCCATGTCATGGAGATCGCTAGTGGGACTGACGTCATCGAAACCCTA
GCTACTTTTGCTAGGCGGCGTCAACGTGGCATCTGCATCTTGAGCGGAAATGGCACAGTGGC
TAACGTCACCCTCCGTCAACCCTCGACCGCTGCCGTTGCGGCGGCTCCTGGTGGTGCGGCTG
TTTTGGCTTTACAAGGGAGGTTTGAGATTCTTTCTTTAACCGGTTCTTTCTTGCCAGGACCG
GCTCCACCTGGTTCCACCGGTTTAACGATTTACTTAGCCGGTGGTCAAGGTCAGGTTGTTGG
AGGAAGCGTGGTGGGCCCATTGATGGCAGCAGGTCCGGTGATGCTGATCGCCGCCACGTTCT
CTAACGCGACTTACGAGAGATTGCCATTGGAGGAGGAAGAGGCAGCAGAGAGAGGCGGTGGT
GGAGGCAGCGGAGGAGTGGTTCCGGGGCAGCTCGGAGGCGGAGGTTCGCCACTAAGCAGCGG
TGCTGGTGGAGGCGACGGTAACCAAGGACTTCCGGTGTATAATATGCCGGGAAATCTTGTTT
CTAATGGTGGCAGTGGTGGAGGAGGACAGATGAGCGGCCAAGAAGCTTATGGTTGGGCTCAA
GCTAGGTCAGGATTTTAA FIGURE 24 (continued)

SEQ ID NO: 177, Arabidopsis thaliana - protein sequence
MANPWWTGQVNLSGLETTPPGSSQLKKPDLHISMNMAMDSGHNNHHHHQEVDNNNNDDDRDN
LSGDDHEPREGAVEAPTRRPRGRPAGSKNKPKPPIFVTRDSPNALKSHVMEIASGTDVIETL
ATFARRRQRGICILSGNGTVANVTLRQPSTAAVAAAPGGAAVLALQGRFEILSLTGSFLPGP
APPGSTGLTIYLAGGQGQVVGGSVVGPLMAAGPVMLIAATFSNATYERLPLEEEEAAERGGG
GGSGGVVPGQLGGGGSPLSSGAGGGDGNQGLPVYNMPGNLVSNGGSGGGGQMSGQEAYGWAQ
ARSGF

SEQ ID NO: 178, Oryza sativa - DNA sequence
ATGGCGTCCAAGGAGCCAAGCGGCGACCACGACCACGAGATGAACGGGACCAGCGCCGGGGG
CGGCGAGCCCAAGGACGGCGCGGTGGTGACCGGCCGCAACCGGCGCCCCGCGGACGGCCGC
CGGGCTCCAAGAACAAGCCCAAGCCGCCCATCTTCGTGACGCGGGACAGCCCGAACGCGCTG
CGCAGCCACGTCATGGAGGTGGCCGGCGGCGCCGATGTCGCCGAGTCCATCGCGCACTTCGC
GCGGCGGCGGCAGCGCGGCGTCTGCGTGCTCAGCGGGGCCGGCACCGTGACCGACGTGGCCC
TGCGCCAGCCGGCCGCGCCGAGCGCCGTGGTGGCGCTCCGTGGGCGGTTCGAGATCCTGTCC
CTGACGGGGACGTTCCTGCCGGGGCCGGCGCCGCCGGGCTCCACCGGGCTGACCGTGTACCT
CGCCGGCGGGCAGGGGCAGGTGGTGGGCGGCAGCGTGGTGGGGACGCTCACCGCGGCGGGGC
CGGTCATGGTGATCGCCTCCACCTTCGCCAACGCCACCTACGAGAGGCTGCCGCTGGATCAG
GAGGAGGAGGAAGCAGCGGCAGGCGGCATGATGGCGCCGCCGCCACTCATGGCCGGCGCCGC
CGATCCACTACTTTTCGGCGGGGGAATGCACGACGCCGGGCTTGCTGCATGGCACCATGCCC
GCCCTCCGCCGCCGCCGCCCTACTAG

SEQ ID NO: 179, Oryza sativa - protein sequence
MASKEPSGDHDHEMNGTSAGGGEPKDGAVVTGRNRRPRGRPPGSKNKPKPPIFVTRDSPNAL
RSHVMEVAGGADVAESIAHFARRRQRGVCVLSGAGTVTDVALRQPAAPSAVVALRGRFEILS
LTGTFLPGPAPPGSTGLTVYLAGGQGQVVGGSVVGTLTAAGPVMVIASTFANATYERLPLDQ
EEEEAAAGGMMAPPPLMAGAADPLLFGGGMHDAGLAAWHHARPPPPPY

SEQ ID NO: 180, Arabidopsis thaliana - DNA sequence
ATGGCAAACCCTTGGTGGACGAACCAGAGTGGTTTAGCGGGCATGGTGGACCATTCGGTCTC
CTCAGGCCATCACCAAAACCATCACCACCAAAGTCTTCTTACCAAAGGAGATCTTGGAATAG
CCATGAATCAGAGCCAAGACAACGACCAAGACGAAGAAGATGATCCTAGAGAAGGAGCCGTT
GAGGTGGTCAACCGTAGACCAAGAGGTAGACCACCAGGATCCAAAAACAAACCCAAAGCTCC
AATCTTTGTGACAAGAGACAGCCCCAACGCACTCCGTAGCCATGTCTTGGAGATCTCCGACG
GCAGTGACGTCGCCGACACAATCGCTCACTTCTCAAGACGCAGGCAACGCGGCGTTTGCGTT
CTCAGCGGGACAGGCTCAGTCGCTAACGTCACCCTCCGCCAAGCCGCCGCACCAGGAGGTGT
GGTCTCTCTCCAAGGCAGGTTTGAAATCTTATCTTTAACCGGTGCTTTCCTCCCTGGACCTT
CCCCACCCGGGTCAACCGGTTTAACGGTTTACTTAGCCGGGGTCCAGGGTCAGGTCGTTGGA
GGTAGCGTTGTAGGCCCACTCTTAGCCATAGGGTCGGTCATGGTGATTGCTGCTACTTTCTC
TAACGCTACTTATGAGAGATTGCCCATGGAAGAAGAGGAAGACGGTGGCGGCTCAAGACAGA
TTCACGGAGGCGGTGACTCACCGCCCAGAATCGGTAGTAACCTGCCTGATCTATCAGGGATG
GCCGGGCCAGGCTACAATATGCCGCCGCATCTGATTCCAAATGGGGCTGGTCAGCTAGGGCA
CGAACCATATACATGGGTCCACGCAAGACCACCTTACTGA

SEQ ID NO: 181, Arabidopsis thaliana - protein sequence
MANPWWTNQSGLAGMVDHSVSSGHHQNHHHQSLLTKGDLGIAMNQSQDNDQDEEDDPREGAV
EVVNRRPRGRPPGSKNKPKAPIFVTRDSPNALRSHVLEISDGSVADTIAHFSRRRQRGVCV
LSGTGSVANVTLRQAAAPGGVVSLQGRFEILSLTGAFLPGPSPPGSTGLTVYLAGVQGQVVG
GSVVGPLLAIGSVMVIAATFSNATYERLPMEEEEDGGGSRQIHGGGDSPPRIGSNLPDLSGM
AGPGYNMPPHLIPNGAGQLGHEPYTWVHARPPY

FIGURE 24 (continued)

SEQ ID NO: 182, Arabidopsis thaliana – DNA sequence
ATGGCTGGTCTTGATCTAGGCACAGCTTTTCGTTACGTTAATCACCAGCTCCATCGTCCCGA
TCTCCACCTTCACCACAATTCCTCCTCCGATGACGTCACTCCCGGAGCCGGGATGGGTCATT
TCACCGTCGACGACGAAGACAACAACAACAACCATCAAGGTCTTGACTTAGCCTCTGGTGGA
GGATCAGGAAGCTCTGGAGGAGGAGGAGGTCACGGCGGGGAGGAGACGTCGTTGGTCGTCG
TCCACGTGGCAGACCACCGGGATCCAAGAACAAACCGAAACCTCCGGTAATTATCACGCGCG
AGAGCGCAAACACTCTAAGAGCTCACATTCTTGAAGTAACAAACGGCTGCGATGTTTTCGAC
TGCGTTGCGACTTATGCTCGTCGGAGACAGCGAGGGATCTGCGTTCTGAGCGGTAGCGGAAC
GGTCACGAACGTCAGCATACGTCAGCCATCTGCGGCTGGAGCGGTTGTGACGCTACAAGGAA
CGTTCGAGATTCTTTCTCTCTCCGGATCGTTTCTTCCTCCTCCGGCACCTCCCGGAGCAACG
AGTTTGACAATTTTCTTAGCCGGAGGACAAGGTCAGGTGGTTGGAGGAAGCGTTGTGGGTGA
GCTTACGGCGGCTGGACCGGTGATTGTGATTGCAGCTTCGTTTACTAATGTTGCTTATGAGA
GACTTCCTTTAGAAGAAGATGAGCAGCAGCAACAGCTTGGAGGAGGATCTAACGGCGGAGGT
AATTTGTTTCCGGAGGTGGCAGCTGGAGGAGGAGGAGGACTTCCGTTCTTTAATTTACCGAT
GAATATGCAACCAAATGTGCAACTTCCGGTGGAAGGTTGGCCGGGGAATTCCGGTGGAAGAG
GTCCTTTCTGA

SEQ ID NO: 183, Arabidopsis thaliana – protein sequence
MAGLDLGTAFRYVNHQLHRPDLHLHHNSSSDDVTPGAGMGHFTVDDEDNNNNHQGLDLASGG
GSGSSGGGGGHGGGGDVVGRRPRGRPPGSKNKPKPPVIITRESANTLRAHILEVTNGCDVFD
CVATYARRRQRGICVLSGSGTVTNVSIRQPSAAGAVVTLQGTFEILSLSGSFLPPPAPPGAT
SLTIFLAGGQGQVVGGSVVGELTAAGPVIVIAASFTNVAYERLPLEEDEQQQQLGGGSNGGG
NLFPEVAAGGGGLPFFNLPMNMQPNVQLPVEGWPGNSGGRGPF

SEQ ID NO: 184, Oryza sativa – DNA sequence
ATGGCAGGTCTCGACCTCGGCACCGCCGCGACGCGCTACGTCCACCAGCTCCACCACCTCCA
CCCCGACCTCCAGCTGCAGCACAGCTACGCCAAGCAGCACGAGCCGTCCGACGACGACCCCA
ACGGCAGCGGCGGCGGCGGCAACAGCAACGGCGGGCCGTACGGGGACCATGACGGCGGGTCC
TCGTCGTCAGGTCCTGCCACCGACGGCGCGGTCGGCGGGCCCGGCGACGTGGTGGCGCGCCG
GCCGCGGGGGCGCCCGCCTGGCTCCAAGAACAAGCCGAAGCCGCCGGTGATCATCACGCGGG
AGAGCGCCAACACGCTGCGCGCCCACATCCTGGAGGTCGGGAGCGGCTGCGACGTGTTCGAG
TGCGTCTCCACGTACGCGCGCCGGCGGCAGCGCGGCGTGTGCGTGCTGAGCGGCAGCGGCGT
GGTCACCAACGTGACGCTGCGTCAGCCGTCGGCGCCCGCGGGCGCCGTCGTGTCGCTGCACG
GGAGGTTCGAGATCCTGTCGCTCTCGGGCTCCTTCCTCCCGCCGCCGGCTCCCCCCGGCGCC
ACCAGCCTCACCATCTTCCTCGCCGGGGGCCAGGGACAGGTCGTCGGCGGCAACGTCGTCGG
CGCGCTCTACGCCGCGGGCCCGGTCATCGTCATCGCGGCGTCCTTCGCCAACGTCGCCTACG
AGCGCCTCCCACTGGAGGAGGAGGAGGCGCCGCCGCCGCAGGCCGGCCTGCAGATGCAGCAG
CCCGGCGGCGGCGCCGATGCTGGTGGCATGGGTGGCGCGTTCCCGCCGGACCCGTCTGCCGC
CGGCCTCCCGTTCTTCAACCTGCCGCTCAACAACATGCCCGGTGGCGGCGGCTCACAGCTCC
CTCCCGGCGCCGACGGCCATGGCTGGGCCGGCGCACGGCCACCGTTCTGA

SEQ ID NO: 185, Oryza sativa – protein sequence
MAGLDLGTAATRYVHQLHHLHPDLQLQHSYAKQHEPSDDDPNGSGGGNSNGGPYGDHDGGS
SSSGPATDGAVGGPGDVVARRPRGRPPGSKNKPKPPVIITRESANTLRAHILEVGSGCDVFE
CVSTYARRRQRGVCVLSGSGVVTNVTLRQPSAPAGAVVSLHGRFEILSLSGSFLPPPAPPGA
TSLTIFLAGGQGQVVGGNVVGALYAAGPVIVIAASFANVAYERLPLEEEEAPPPQAGLQMQQ
PGGGADAGGMGGAFPPDPSAAGLPFFNLPLNNMPGGGSQLPPGADGHGWAGARPPF

FIGURE 24 (continued)

SEQ ID NO: 186, Arabidopsis thaliana - DNA sequence
ATGGCTGGTCTCGATCTAGGCACAACTTCTCGCTACGTCCACAACGTCGATGGTGGCGGCGG
CGGACAGTTCACCACCGACAACCACCACGAAGATGACGGTGGCGCTGGAGGAAACCACCATC
ATCACCATCATAATCATAATCACCATCAAGGTTTAGATTTAATAGCTTCTAATGATAACTCT
GGACTAGGCGGCGGTGGAGGAGGAGGGAGCGGTGACCTCGTCATGCGTCGGCCACGTGGCCG
TCCAGCTGGATCGAAGAACAAACCGAAGCCGCCGGTGATTGTCACGCGCGAGAGCGCAAACA
CTCTTAGGGCTCACATTCTTGAAGTTGGAAGTGGCTGCGACGTTTTCGAATGTATCTCCACT
TACGCTCGTCGGAGACAGCGCGGGATTTGCGTTTTATCCGGGACGGGAACCGTCACTAACGT
CAGCATCCGTCAGCCTACGGCGGCCGGAGCTGTTGTGACTCTGCGGGGTACTTTTGAGATTC
TTTCCCTCTCCGGATCTTTTCTTCCGCCACCTGCTCCTCCAGGGGCGACTAGCTTGACGATA
TTCCTCGCTGGAGCTCAAGGACAGGTCGTCGGAGGTAACGTAGTTGGTGAGTTAATGGCGGC
GGGGCCGGTAATGGTCATGGCAGCGTCTTTTACAAACGTGGCTTACGAAAGGTTGCCTTTGG
ACGAGCATGAGGAGCACTTGCAAAGTGGCGGCGGCGGAGGTGGAGGGAATATGTACTCGGAA
GCCACTGGCGGTGGCGGAGGGTTGCCTTTCTTTAATTTGCCGATGAGTATGCCTCAGATTGG
AGTTGAAAGTTGGCAGGGGAATCACGCCGGCGCCGGTAGGGCTCCGTTTTAG

SEQ ID NO: 187, Arabidopsis thaliana - protein sequence
MAGLDLGTTSRYVHNVDGGGGGQFTTDNHHEDDGGAGGNHHHHHHNHNHHQGLDLIASNDNS
GLGGGGGGGSGDLVMRRPRGRPAGSKNKPKPPVIVTRESANTLRAHILEVGSGCDVFECIST
YARRRQRGICVLSGTGTVTNVSIRQPTAAGAVVTLRGTFEILSLSGSFLPPPAPPGATSLTI
FLAGAQGQVVGGNVVGELMAAGPVMVMAASFTNVAYERLPLDEHEEHLQSGGGGGGGNMYSE
ATGGGGLPFFNLPMSMPQIGVESWQGNHAGAGRAPF

SEQ ID NO: 188, Medicago truncatula - DNA sequence
ATGGATCAAGTAGCACAAGGTCGTCCTCTTCCACCTCCATTTCTCACTAGAGACCTTCATCT
TCATCCTCACCATCAATTTCACACCAACCACCAAACCAATGAAGAGGAACAACAAAGTGGCA
ATGGGAGCTTAAGCCGAGGCCAAAAAAGAGAACGAAACAACGAAGACGGCAACAACACTCCC
ACCGGAGGAGAAGGAAAAGACGACGGTGGTAGCGGAAGTGCTGGTGGAGGAAGTGGTGGTGA
GATGGGAAGAAGACCAAGAGGAAGACCAGCAGGTTCGAAAAACAAACCAAAACCACCTATCA
TCATCACGAGGGACAGCGCGAACGCACTCCGATCCCACGTGATGGAAGTTGCAAATGGATGT
GACATCATGGAAAGTGTGACGGTCTTTGCGCGAAGGAGGCAGCGTGGTGTCTGCATCCTTAG
CGGAAGTGGGACCGTCACAAACGTGACTCTCCGTCAACCAGCATCGCCTGGTGCGGTAGTCA
CACTTCATGGAAGATTTGAGATATTATCATTATCTGGCTCTTTCCTGCCGCCGCCTGCTCCA
CCAGCGGCGTCAGGATTAGCCATATATCTAGCTGGTGGACAAGGACAGGTCGTCGGTGGTAG
CGTGGTGGGACCGTTGTTAGCTTCCGGTCCGGTTGTTATCATGGCAGCTTCCTTTGGAAATG
CTGCTTATGAAAGGCTACCTTTAGAAGATGAAGAAACACCAGTGAATGTGCCAGGAAATGGA
GGGTTAGGGTCACCGGGAACCATGGGAAGTCAACAACAACAGCAGCAGAACCAGCAACAGCA
ACAACTTGTAGCAGATCCTAATGCTTCATCACTTTTCCATGGAGTTCCTCAAAATCTTCTCA
ATTCATGCCAATTACCAGCTGAAGGTTATTGGGGTGGAAGTGCTCGTCCTCCTTTTTTAACC
AAAAATGTTATTCACTTAATCACTTTTCTCATCATGTTTTTCGTTTAA

SEQ ID NO: 189, Medicago truncatula - protein sequence
MDQVAQGRPLPPPFLTRDLHLHPHHQFHTNHQTNEEEQQSGNGSLSRGQKRERNNEDGNNTP
TGGEGKDDGGSGSAGGGSGGEMGRRPRGRPAGSKNKPKPPIIITRDSANALRSHVMEVANGC
DIMESVTVFARRRQRGVCILSGSGTVTNVTLRQPASPGAVVTLHGRFEILSLSGSFLPPPAP
PAASGLAIYLAGGQGQVVGGSVVGPLLASGPVVIMAASFGNAAYERLPLEDEETPVNVPGNG
GLGSPGTMGSQQQQQQNQQQQQLVADPNASSLFHGVPQNLLNSCQLPAEGYWGGSARPPFLT
KNVIHLITFLIMFFV

FIGURE 24 (continued)

SEQ ID NO: 190, Artificial sequence – motif 1
QGQ V/I GG

SEQ ID NO: 191, Artificial sequence – motif 2
ILSLSGSFLPPPAPP

SEQ ID NO: 192, Artificial sequence – motif 3
NATYERLP

SEQ ID NO: 193, Artificial sequence – motif 4
SFTNVAYERLPL

SEQ ID NO: 194, Artificial sequence – motif 5
GRFEILSLTGSFLPGPAPPGSTGLTIYLAGGQGQVVGGSVVG

SEQ ID NO: 195, Oryza sativa – prolamin promoter
CTTCTACATCGGCTTAGGTGTAGCAACACGACTTTATTATTATTATTATTATTATTATT
ATTTTACAAAAATATAAAATAGATCAGTCCCTCACCACAAGTAGAGCAAGTTGGTGAGTTAT
TGTAAAGTTCTACAAAGCTAATTTAAAAGTTATTGCATTAACTTATTTCATATTACAAACAA
GAGTGTCAATGGAACAATGAAAACCATATGACATACTATAATTTTGTTTTTATTATTGAAAT
TATATAATTCAAAGAGAATAAATCCACATAGCCGTAAAGTTCTACATGTGGTGCATTACCAA
AATATATATAGCTTACAAAACATGACAAGCTTAGTTTGAAAAATTGCAATCCTTATCACATT
GACACATAAAGTGAGTGATGAGTCATAATATTATTTTCTTTGCTACCCATCATGTATATATG
ATAGCCACAAAGTTACTTTGATGATGATATCAAGAACATTTTTAGGTGCACCTAACAGAAT
ATCCAAATAATATGACTCACTTAGATCATAATAGAGCATCAAGTAAAACTAACACTCTAAAG
CAACCGATGGGAAAGCATCTATAAATAGACAAGCACAATGAAAATCCTCATCATCCTTCACC
ACAATTCAAATATTATAGTTGAAGCATAGTAGTA

SEQ ID NO: 196, Artificial sequence – primer
GGGGACAAGTTTGTACAAAAAAGCAGGCTTAAACAATGGATCCGGTCACGG

SEQ ID NO: 197, Artificial sequence – primer
GGGGACCACTTTGTACAAGAAAGCTGGGTGGAATCGATCCATCTCAGAA

FIGURE 24 (continued)

SEQ ID NO: 198, Arabidopsis thaliana - DNA
ATGGGTGGATCGATGTCGGAGAGAGCAAGGCAGGCCAACATTCCTCCACTAGCGGGACCCCT
AAAGTGTCCTCGATGCGACTCCAGCAACACTAAGTTCTGTTACTACAACAACTATAACCTCA
CTCAGCCTCGTCACTTCTGCAAAGGTTGCCGTCGCTACTGGACACAAGGGGGCGCCCTGAGA
AACGTCCCTGTAGGTGGAGGCTGCCGGAGGAATAACAAGAAGGGCAAAAATGGAAATTTAAA
ATCTTCTTCTTCTTCGTCCAAACAGTCTTCCTCGGTCAACGCTCAAAGTCCTAGCTCAGGAC
AGCTAAGGACAAATCATCAGTTCCCTTTTTCACCAACTCTTTACAATCTCACTCAACTCGGA
GGTATTGGTTTGAACTTAGCCGCTACTAATGGCAACAACCAAGCTCACCAGATCGGTTCCAG
TTTGATGATGAGCGATCTAGGGTTTCTCCATGGACGAAATACTTCAACTCCGATGACGGGAA
ACATTCATGAAAACAACAACAATAATAACAATGAAAACAACCTAATGGCATCCGTTGGATCT
TTGAGCCCCTTTGCTCTCTTCGATCCAACGACGGGGCTATACGCTTTCCAGAACGACGGTAA
TATCGGGAACAACGTTGGGATATCTGGCTCTTCTACTTCCATGGTTGATTCTAGGGTTTATC
AGACGCCTCCGGTGAAGATGGAAGAACAACCTAATTGGCTAACTTGTCTAGACCGGTCTCC
GGTTTGACGTCTCCTGGGAATCAAACAAATCAGTACTTTTGGCCTGGTTCGGATTTCTCGGG
TCCTTCTAATGATCTCTTGTGA

SEQ ID NO: 199, Arabidopsis thaliana - protein
MGGSMSERARQANIPPLAGPLKCPRCDSSNTKFCYYNNYNLTQPRHFCKGCRRYWTQGGALR
NVPVGGGCRRNNKKGKNGNLKSSSSSSKQSSSVNAQSPSSGQLRTNHQFPFSPTLYNLTQLG
GIGLNLAATNGNNQAHQIGSSLMMSDLGFLHGRNTSTPMTGNIHENNNNNNNENNLMASVGS
LSPFALFDPTTGLYAFQNDGNIGNNVGISGSSTSMVDSRVYQTPPVKMEEQPNLANLSRPVS
GLTSPGNQTNQYFWPGSDFSGPSNDLL

SEQ ID NO: 200, Artificial sequence - protein - DOF domain
PLAGPLKCPRCDSSNTKFCYYNNYNLTQPRHFCKGCRRYWTQGGALRNVPVGGGCRRNNKKG
K

SEQ ID NO: 201, Arabidopsis thaliana - DNA - ARF155816
ATGGCGGAGAGAGCAAGGCAGGCCAACATTCCTCCACTAGCGGGACCCCTAAAGTGTCCTCG
ATGCGACTCCAGCAACACTAAGTTCTGTTACTACAACAACTATAACCTCACTCAGCCTCGTC
ACTTCTGCAAAGGTTGCCGTCGCTACTGGACACAAGGGGGCGCCCTGAGAAACGTCCCTGTA
GGTGGAGGCTGCCGGAGGAATAACAAGAAGGGCAAAAATGGAAATTTAAAATCTTCTTCTTC
TTCGTCCAAACAGTCTTCCTCGGTCAACGCTCAAAGTCCTAGCTCAGGACAGCTAAGGACAA
ATCATCAGTTCCCTTTTTCACCAACTCTTTACAATCTCACTCAACTCGGAGGTATTGGTTTG
AACTTAGCCGCTACTAATGGCAACAACCAAGCTCACCAGATCGGTTCCAGTTTGATGATGAG
CGATCTAGGGTTTCTCCATGGACGAAATACTTCAACTCCGATGACGGGAAACATTCATGAAA
ACAACAACAATAATAACAATGAAAACAACCTAATGGCATCCGTTGGATCTTTGAGCCCCTTT
GCTCTCTTCGATCCAACGACGGGGCTATACGCTTTCCAGAACGACGGTAATATCGGGAACAA
CGTTGGGATATCTGGTTCTTCTACTTCCATGGTTGATTCTAGGGTTTATCAGACGCTCCGGT
GA

SEQ ID NO: 202, Arabidopsis thaliana - protein
MAERARQANIPPLAGPLKCPRCDSSNTKFCYYNNYNLTQPRHFCKGCRRYWTQGGALRNVPV
GGGCRRNNKKGKNGNLKSSSSSSKQSSSVNAQSPSSGQLRTNHQFPFSPTLYNLTQLGGIGL
NLAATNGNNQAHQIGSSLMMSDLGFLHGRNTSTPMTGNIHENNNNNNNENNLMASVGSLSPF
ALFDPTTGLYAFQNDGNIGNNVGISGSSTSMVDSRVYQTLR

FIGURE 28

SEQ ID NO: 203, Arabidopsis thaliana - DNA - AY088198
ATGCCTACGAATTCGAATCATCAGCATCATCTTCAACACCAGCTTAACGAAAATGGAAGTAT
AATAAGTGGCCACGGACTAGTACTCTCTCACCAACTTCCACCTCTCCAAGCAAACCCTAACC
CTAACCACCACCATGTCGCTACCTCTGCTGGTCTTCCGTCAAGGATGGGTGGATCGATGGCG
GAGAGAGCAAGGCAGGCCAACATTCCTCCACTAGCGGGACCCCTAAAGTGTCCTCGATGCGA
CTCCAGCAACACTAAGTTCTGTTACTACAACAACTATAACCTCACTCAGCCTCGTTACTTCT
GCAAAGGTTGCCGTCGCTACTGGACACAAGGGGCGCCCTGAGAAACGTCCCTGTAGGTGGA
GGCTGCCGGAGGAATAACAAGAAGGGCAAAAATGGAAATTTAAAATCTTCTTCTTCTTCGTC
CAAACAGTCTTCCTCGGTCAACGCTCAAAGTCCTAGCTCAGGACAGCTAAGGACAAATCATC
AGTTCCCTTTTTCACCAACTCTTTACAATCTCACTCAACTCGGAGGTATTGGTTTGAACTTA
GCCGCTACTAATGGCAACAACCAAGCTCACCAGATCGGTTCCAGTTTGATGATGAGCGATCT
AGGGTTTCTCCATGGACGAAATACTTCAACTCCGATGACGGGAAACATTCATGAAAACAACA
ACAATAATAACAATGAAAACAACCTAATGGCATCCGTTGGATCTTTGAGCCCCTTTGCTCTC
TTCGATCCAACGACGGGGCTATACGCTTTCCAGAACGACGGTAATATCGGGAACAACGTTGG
GATATCTGGTTCTTCTACTTCCATGGTTGATTCTAGGGTTTATCAGACGCCTCCGGTGAAGA
TGGAAGAACAACCTAATTTGGCTAACTTGTCTAGACCGGTCTCCGGTTTGACGTCTCCTGGG
AATCAAACAAATCAATACTTTTGGCCTGGTTCGGATTTCTCGGGTCCTTCTAATGATATCTT
G

SEQ ID NO: 204, Arabidopsis thaliana - protein
MPTNSNHQHHLQHQLNENGSIISGHGLVLSHQLPPLQANPNPNHHHVATSAGLPSRMGGSMA
ERARQANIPPLAGPLKCPRCDSSNTKFCYYNNYNLTQPRYFCKGCRRYWTQGGALRNVPVGG
GCRRNNKKGKNGNLKSSSSSSKQSSSVNAQSPSSGQLRTNHQFPFSPTLYNLTQLGGIGLNL
AATNGNNQAHQIGSSLMMSDLGFLHGRNTSTPMTGNIHENNNNNNNENNLMASVGSLSPFAL
FDPTTGLYAFQNDGNIGNNVGISGSSTSMVDSRVYQTPPVKMEEQPNLANLSRPVSGLTSPG
NQTNQYFWPGSDFSGPSNDIL

SEQ ID NO: 205, Oryza sativa - DNA
ATGATTCCGGGCACGCTTGCCGATGGCGGCGGCGGAGGCGGCGCGGTGGGGCCGGCGAAGCC
GATGTCGATGTCGGAGAGGGCGCGGCTGGCGAGGATCCCGCTGCCGGAGCCGGGGCTCAAGT
GCCCGCGCTGCGACTCCACCAACACCAAGTTCTGCTACTTCAACAACTACTCCCTCTCCCAG
CCCCGCCACTTCTGCCGCGCCTGCCGCCGCTACTGGACCCGCGGCGGCGCGCTCCGCAACGT
CCCCGTCGGCGGCGGCTACCGCCGCCACGCCAAGCGCGCCAAGCCCAAGCCGGCGTCCGCGG
CGGGCTCCGCCTCAGCCGCCACCACCACCGCCGGCTCGACGCCAGCGGGGTCGACGACGACG
ACGACGACGTCCTCCACCTGCGCCACGCCCAACGCGCCCGCCCTCCCGGCGATGCTGGGCGG
CAACCTCTCCATCCTGCCGCCGCTGCTCCGCCTCGCCGACTTCGACGCCATGAGCCTCGGCT
CCACCTTCTCTGGCATGGCGGCGGCCGCCGGCAAGCCACCGCCCGTCGACGCGGCCGGCTGC
TACTCCGTCGGCGCCGCCACCGGCCTCGAGCAATGGAGACTACAGCAGATGCAGAGCTTCCC
GTTCTTCCACGCCATGGATCACCAGGCGGCGATGGCGGCGCCACCGCCGGCAATGGCAATGC
CGGGGATGTTCCAGCTAGGCCTAGACGGCGACGGCCATGGCAGCGGCGGCGGCGAAGACGGT
GGAGAGCTCCACCATGCGATGCCATCATCGAAGAGAGAAGGCTACCCAAGGGGCATGTATGG
CGATCATCACCTCGCTGGAGGATACACCTCCTACTCCAGTGCAACCACAGGTAACCATCTCT
TGTAA

SEQ ID NO: 206, Oryza sativa - protein - AAU44212.1
MIPGTLADGGGGGGAVGPAKPMSMSERARLARIPLPEPGLKCPRCDSTNTKFCYFNNYSLSQ
PRHFCRACRRYWTRGGALRNVPVGGYRRHAKRAKPKPASAAGSASAATTTAGSTPAGSTTT
TTTSSTCATPNAPALPAMLGGNLSILPPLLRLADFDAMSLGSTFSGMAAAAGKPPPVDAAGC
YSVGAATGLEQWRLQQMQSFPFFHAMDHQAAMAAPPPAMAMPGMFQLGLDGDGHGSGGGEDG
GELHHAMPSSKREGYPRGMYGDHHLAGGYTSYSSATTGNHLL

FIGURE 28 (continued)

SEQ ID NO: 207, Oryza sativa - DNA
ATGCCGCCGCATCACGGCGGCCTCATGGCGCCTCGGCCTGACATGGTAGCAGCGGCCGTCGC
GGCGAGCGGCGGCGGCGGTGGCGGCGGCGGCCCGACCGGCGGCACGGCGGTGCGGCCGGGCT
CGATGACGGAACGGGCTCGGCTGGCGAAGATCCCGCAGCCGGAGCCGGGGCTCAAGTGCCCG
CGCTGCGAGTCCACCAACACCAAGTTCTGCTACTTCAACAACTACTCGCTCTCGCAGCCGCG
CCACTTCTGCAAGACGTGCCGCCGCTACTGGACGCGCGGCGGAGCGCTCCGCAACGTCCCCG
TCGGCGGCGGGTGCCGCCGCAACAAGCGCACCAAGTCGTCCAAGTCGTCCTCGTCGACGTCG
GCCGCCGGCTCGGCCTCCGCCACCGGCGGCACGTCGTCGTCCACATCGTCGACCGCCACGGG
TGGCAGCAGCAGCGCCGCGGCGGCCGCGGCGATGATGCCGCCGCAGGCGCAGCTGCCGTTCC
TGGCCTCGTTGCACCACCCGCTCGGCGGCGGCGATCACTACAGCTCCGGTGCGTCCAGGCTA
GGGTTTCCCGGATTGAGCTCGCTGGATCCCGTCGACTACCAGCTCGGCGGCGGCGCCGCCGC
CGCCGCCGCCATCGGGCTAGAGCAGTGGCGCCTCCCGCAGATACAGCAATTCCCCTTCTTGA
GCCGCAACGACGCCATGCCGCCGCCAATGTCCGGCATTTACCCGTTCGACGCGGAGGCCGCC
GCCGACGCCGCCGGCTTCGCCGGCCAGTTGCTGGCCGGCACCAAGGTGCCCGGCTCGTCGGG
CCTGATCACGCAGCTCGCATCCGTCAAGATGGAGGACAGCAACGCTCAGTCCGCGGCGATGA
ACAGCTCGCCGAGGGAGTTCTTGGGCCTCCCCGGCAACCTCCAATTCTGGGGCGGTGGCAAC
GGCGCGGGACCCGGCGGCAATGGAGACGGCGCCACCGGCGGCAGCGGCGCCGGTGTCGCTCC
GGGAGGCGGCGGCAGCGGCGGCGGATGGGCTGATCTCTCCGGATTCAACTCGTCGTCGTCGG
GGAACATACTGTGA

SEQ ID NO: 208, Oryza sativa - protein - XP_470142.1
MPPHHGGLMAPRPDMVAAAVAASGGGGGGGGPTGGTAVRPGSMTERARLAKIPQPEPGLKCP
RCESTNTKFCYFNNYSLSQPRHFCKTCRRYWTRGGALRNVPVGGGCRRNKRTKSSKSSSSTS
AAGSASATGGTSSSTSSTATGGSSSAAAAAAMMPPQAQLPFLASLHHPLGGGDHYSSGASRL
GFPGLSSLDPVDYQLGGGAAAAAAIGLEQWRLPQIQQFPFLSRNDAMPPPMSGIYPFDAEAA
ADAAGFAGQLLAGTKVPGSSGLITQLASVKMEDSNAQSAAMNSSPREFLGLPGNLQFWGGGN
GAGPGGNGDGATGGSGAGVAPGGGSGGGWADLSGFNSSSSGNIL

SEQ ID NO: 209, Triticum aestivum - DNA
CTCCTAGCTCGTCGACAAGCATGCCCACAAAGCCACTGATAACAAGCGCATAGCAGCGCACG
CTCTCTTATAGTAGAATGTTCTGAACTCCACACCAGCCCATGCAAGACTTCCAGTCCATCCC
GGGCCTCGCCGGGCGGCTGTTCGGCGGCGCGGCCGCGGCAGACATCCGGCGCGTGCAGGGCC
CGGCGTCCCGGTGCGGCGTGTTCTCGCAGGCGGCGTCCGCGCAGCCGGAGGCGGCCGTCAAG
TGCCCGCGGTGCGAGTCCACCAACACCAAGTTCTGCTACTACAACAACTACAACCTGTCGCA
GCCGCGCCACTTCTGCAAGAGCTGCCGCCGGTACTGGACCAAGGGCGGCGTCCTCCGCAACG
TCCCCGTCGGCGGCGGCTGCCGCAAGGCCAAGCGCAGCTCCTCGTCGGCGTCCGCACCGTCG
ACGCCCGCGGCCACGGACGCCAAGAGCCAGCGGCGCGCGTCCGCGTCGTCCTCCTCCCGCTC
CAACAGCGGCAGCGGCAGCGCCAGCCCCACGGCCGCTGCGGAAGAGACGACGACAACGGAGA
CCGAGCCCCCTCCTCCGCCCACGCCGTCGTCCAACTCCAACTCCAACGCGGTCTCCTTCGCC
AACCGCATGACGAACTACCCCTTCGCGGCAGACGTGCCACCTCTGGCGCCGATATTCGCCGA
CCAGGCCGCCGCGCTCGCGTCCCTCTTCGCGCCGCCTCCTCCACCGCCTCTCCCGGTGTTCA
GCTTCTCGGCGGAGCCCAAGATGGAGGAGGCGATCGGGTCACTGCTGCTCCCGGGGCAGGAG
GCGTCGCAGGAGCCAGAGGAGCCCACCTGCACCTCCACCGTCGCGGACATGGCGCCGTTCAT
GTCGCTGGACGCGGGGATCTTCGAGCTCGGCGACGCGTCGCCGGCCGATTACTGGAACGGCG
GGAGCTGCTGGACGGACGTCCAGGACCCGTCCGTCTACCTACCCTAGTTTGGCTTAGTTCCT
CATCACGA

FIGURE 28 (continued)

SEQ ID NO: 210, Triticum aestivum – protein – AAX54942
MQDFQSIPGLAGRLFGGAAAADIRRVQGPASRCGVFSQAASAQPEAAVKCPRCESTNTKFCY
YNNYNLSQPRHFCKSCRRYWTKGGVLRNVPVGGGCRKAKRSSSSASAPSTPAATDAKSQRRA
SASSSSRSNSGSGSASPTAAAEETTTTETEPPPPPTPSSNSNSNAVSFANRMTNYPFAADVP
PLAPIFADQAAALASLFAPPPPPPLPVFSFSAEPKMEEAIGSLLLPGQEASQEPEEPTCTST
VADMAPFMSLDAGIFELGDASPADYWNGGSCWTDVQDPSVYLP

SEQ ID NO: 211, Zea mays – DNA
AGGTGGTGGCGGGGGACAGGTTGGGGGCCCCGCCAAGCCCATGTCCATGGCGGAGCGCGCGC
GCCTCGCGAGGATCCCACTGCCGGAGCCGGGACTCAAGTGCCCGCGCTGCGACTCAACCAAC
ACCAAGTTCTGCTACTTCAACAACTACTCCCTCACGCAGCCGCGCCACTTCTGCCGGGCCTG
CCGCCGCTACTGGACGCGTGGCGGCGCGCTCCGCAACGTGCCGGTCGGTGGCGGATACCGCC
GCCACGCCAAGCGCGCCAAGCCCAAGCAGCAGCAGCAGCACGCGGCCGCCGGGACCGGAGCT
GCCAACGGCGCGATGCAGCAGCCTCCCGCTGGGTCTATGGCGTCGTCGGCCGCCGCCTGCAC
CGCGACCACGACGATGACGACCAACGCGCTGGACGCCGGGCCCGGCGGCATGCTGCCCATGC
TGCCGCCGCTCGTCCGCCTAGCAGACTTCGACGCAATGAGCCTCGGCTCCAGCTTCTCCGGG
ATATCGTCCATGGGGAAGCCCGGATCCATCGGCGCGGCCTGCTACCCGCACTCTGTCGGCGG
GCTGGAGCAGTGGAGGGTGCAGCAGATGCAGAGCTTCCCGTTCTTGCATGCGATGGACCAGG
GCCCGCTGGGGCCACCTCTGGCCATGGCGATGGCGGCGCCAGGAGGGATGTTCCAGCTAGGT
CTAGACACCACCAGTGATAACAGCCGTGGCGGTGGCGGCGGCGGCTGCGGCGAAGACGGGTC
GTCTGCGGGAGAGGCGCTCCATATGATGCAAGCAGCCACCAAGAGGGAGAGCTACCCGGCAC
CACCAAGAGCCATGTACGGCGACCAACACCACAATCACCTCGCTGCTGCTGGTGGCTACACT
TCCTATTCCACCAATGCTGCTGCAGGTAACCATCTCTTGTAATGGCCGGCCGATCGATCGAT
CGAGAGCTCAACAATTCAAGTGTCCTGCTATAGCTAGCTACTACGACGTCGTGCTACGATCG
TATCGGTTTCGGTTCGTTCCTACAAATATAGCCTAGAGATAGAGTGTCTCTGTCTGTGTGAT
CGATGGTATTGTTATGATCATATAGAAAAGACCAGTGTAGCATGCATGCACTTGTTGCAATG
TTTGCTTTCAAGAAGAAACTGGAGGGAGGAGAGGCTCGGTTTGGATGCTGATCATGCACAAA
TATTACTAGTGTCTACAGCTGCTACTTCATTATAAAAAAAAAAAAAAAAAA

SEQ ID NO: 212, Zea mays – protein – CAA54288
GGGGGQVGGPAKPMSMAERARLARIPLPEPGLKCPRCDSTNTKFCYFNNYSLTQPRHFCRAC
RRYWTRGGALRNVPVGGGYRRHAKRAKPKQQQQHAAAGTGAANGAMQQPPAGSMASSAAACT
ATTTMTTNALDAGPGGMLPMLPPLVRLADFDAMSLGSSFSGISSMGKPGSIGAACYPHSVGG
LEQWRVQQMQSFPFLHAMDQGPLGPPLAMAMAAPGGMFQLGLDTTSDNSRGGGGGGCGEDGS
SAGEALHMMQAATKRESYPAPPRAMYGDQHHNHLAAAGGYTSYSTNAAAGNHLL

SEQ ID NO: 213, Solanum tuberosum – DNA
GAGGACTTATCAACCTTTTTATATAAAGAGATAAAGATCAAAGAGATCAAAGAAAGAAAAT
CATGGTTTTCTCATCTTTTCCTGTGTATCTAGATCATCCCAATTTGCATCAGTTACAACAGC
CAGACGGCCATCAACAAGGAAATACTGGGCTGGAGAATCCAACTCTGCAGCCCCCACCTATG
CAGGTGGGGGCTAGTCCGGGCTCAATCAGACCAGGTTCTATGGTGGATCGAGCCCGGTTAGC
TAAGATTCCACTACCGGAAGCTGGATTAAAGTGTCCAAGGTGTGATTCAACAAACACAAAGT
TCTGCTACTTCAACAACTACAACCTTTCCAACCAAGACACTTCTGCAAGACCTGTCGCCGG
TACTGGACTAGAGGGGCGCCTTGAGAAGCGTGCCGGTAGGAGGAGGATGCCGGAGGAACAA
GAGAAGCAAAAGTAATAACAACAACAACAGCTCAAAGACAGCTGGCAGTAATGTCAATACTA
ATACTATTGCTTCCGGTACTTCAACAAGTGCAAGTCCTTCAAGCTGCAGCACGGAAATAATG
AATGGTCGCCATCACTTCTCTCATGAGCAACCACCGCAGTTAACTCCTCTCATGGCTGCTTT

FIGURE 28 (continued)

CCAAAATCTTAATCATCACTATGGCGGATTTCAACCTCCTCCTTTGGTTTCAACACACCATG
GGAATGGAACCGGCGCGCTTGGTCATCATCATGAAATGGGATTTCAAATAGGGAGTAGTACT
AATACTAACAATTTACCTGTACCCCCAGGAGGAGGATCTGATCATCAGTGGAGATTACCATC
TTTGGCAGCAAACACAAATTTGTACCCTTTTCAACACGGTACTGATCAAGGAATTCATGAAT
CATCATCTGTTAACAATAATAATATTAATGCTCATGATGACCAAGGGTTAAATTCGACCAAA
CAGTTTTTGGGAACAATGGAAATAATACTAATCAATATTGGGGTGGAAACGCATGGACAGG
GTTTTCTGGATTAAACTCATCTTCTTCAGCAAGCCATCTACTTTGATTTCATTCATGTAAGT
CAATTTGTGTACTTGACTCTCAACGATTAAAATGTTGTATGTGTTGGGAGGGGGGTCTAAAT
TAGATATATAGTATACTGGGGGCATGTTTAAGTCTTTGTTATTCCATGGTCATTATCACCAC
TTGTAATTTTACTGGATGTTTTTTTTTATAACTTAGGTGTGTGAAGTTGTATTGTGAGTTT
TAA

SEQ ID NO: 214, Solanum tuberosum - protein - CAB89831
MVFSSFPVYLDHPNLHQLQQPDGHQQGNTGLENPTLQPPPMQVGASPGSIRPGSMVDRARLA
KIPLPEAGLKCPRCDSTNTKFCYFNNYNLSQPRHFCKTCRRYWTRGGALRSVPVGGGCRRNK
RSKSNNNNNSSKTAGSNVNTNTIASGTSTSASPSSCSTEIMNGRHHFSHEQPPQLTPLMAAF
QNLNHHYGGFQPPPLVSTHHGNGTGALGHHHEMGFQIGSSTNTNNLPVPPGGGSDHQWRLPS
LAANTNLYPFQHGTDQGIHESSSVNNNNINAHDDQGLNSTKQFLGTMENNTNQYWGGNAWTG
FSGLNSSSSASHLL

SEQ ID NO: 215, Arabidopsis thaliana - DNA
ATGCCTACGAATTCGAATCATCAGCATCATCTTCAACACCAGCTTAACGAAAATGGAAGTAT
AATAAGTGGCCACGGACTAGTACTCTCTCACCAACTTCCACCTCTCCAAGCAAACCCTAACC
CTAACCACCACCATGTCGCTACCTCTGCTGGTCTTCCGTCAAGGATGGGTGGATCGATGGCG
GAGAGAGCAAGGCAGGCCAACATTCCTCCACTAGCGGGACCCCTAAAGTGTCCTCGATGCGA
CTCCAGCAACACTAAGTTCTGTTACTACAACAACTATAACCTCACTCAGCCTCGTCACTTCT
GCAAAGGTTGCCGTCGCTACTGGACACAAGGGGCGCCCTGAGAAACGTCCCTGTAGGTGGA
GGCTGCCGGAGGAATAACAAGAAGGGCAAAAATGGAAATTTAAAATCTTCTTCTTCTTCGTC
CAAACAGTCTTCCTCGGTCAACGCTCAAAGTCCTAGCTCAGGACAGCTAAGGACAAATCATC
AGTTCCCTTTTTCACCAACTCTTTACAATCTCACTCAACTCGGAGGTATTGGTTTGAACTTA
GCCGCTACTAATGGCAACAACCAAGCTCACCAGATCGGTTCCAGTTTGATGATGAGCGATCT
AGGGTTTCTCCATGGACGAAATACTTCAACTCCGATGACGGGAAACATTCATGAAAACAACA
ACAATAATAACAATGAAAACAACCTAATGGCATCCGTTGGATCTTTGAGCCCCTTTGCTCTC
TTCGATCCAACGACGGGGCTATACGCTTTCCAGAACGACGGTAATATCGGGAACAACGTTGG
GATATCTGGTTCTTCTACTTCCATGGTTGATTCTAGGGTTTATCAGACGCCTCCGGTGAAGA
TGGAAGAACAACCTAATTTGGCTAACTTGTCTAGACCGGTCTCCGGTTTGACGTCTCCTGGG
AATCAAACAAATCAGTACTTTTGGCCTGGTTCGGATTTCTCGGGTCCTTCTAATGATCTCTT
GTGA

SEQ ID NO: 216, Arabidopsis thaliana - protein - At1g07640
MGGSMAERARQANIPPLAGPLKCPRCDSSNTKFCYYNNYNLTQPRHFCKGCRRYWTQGGALR
NVPVGGGCRRNNKKGKNGNLKSSSSSKQSSSVNAQSPSSGQLRTNHQFPFSPTLYNLTQLG
GIGLNLAATNGNNQAHQIGSSLMMSDLGFLHGRNTSTPMTGNIHENNNNNNNENNLMASVGS
LSPFALFDPTTGLYAFQNDGNIGNNVGISGSSTSMVDSRVYQTPPVKMEEQPNLANLSRPVS
GLTSPGNQTNQYFWPGSDFSGPSNDLL

FIGURE 28 (continued)

SEQ ID NO: 217, Arabidopsis thaliana - DNA
ATGGTTTTCTCCTCCATCCAAGCCTATCTTGATTCATCCAACTGGCAACAGGCTCCTCCGAG
CAATTATAATCATGACGGAACAGGCGCCTCAGCAAATGGAGGTCATGTTCTTCGTCCTCAGC
TGCAGCCACAGCAGCAGCCACAGCAGCAGCCGCATCCTAATGGGAGCGGGGGCGGAGGTGGA
GGTGGAGGCGGCTCGATCCGAGCAGGATCAATGGTGGACAGAGCAAGACAAGCAAACGTAGC
CTTGCCAGAAGCAGCACTGAAATGTCCGAGATGCGAATCCACCAACACCAAGTTCTGCTACT
TCAACAACTACAGCCTCACTCAACCACGCCACTTCTGCAAGACCTGCCGGAGATACTGGACA
CGTGGCGGAGCTCTCCGCAACGTCCCAGTCGGCGGTGGCTGCCGGAGAAACAGGCGTACCAA
AAGCAACAGCAACAACAACAATAACAGCACTGCTACTAGCAATAACACCAGTTTCTCCTCCG
GGAATGCATCCACCATCAGCACGATTCTCTCCTCCCACTATGGAGGAAACCAAGAGAGTATC
TTAAGCCAGATTTTGTCTCCGGCGAGGCTAATGAATCCTACTTACAATCATCTCGGAGATCT
CACAAGTAATACAAAAACAGACAACAACATGAGCTTGTTGAACTATGGAGGATTGAGTCAAG
ACTTGAGGTCAATCCACATGGGAGCTTCTGGTGGCTCGCTTATGAGCTGTGTTGATGAATGG
AGATCGGCGTCTTATCATCAGCAGTCAAGTATGGGCGGTGGGAACTTGGAGGATTCTTCTAA
TCCTAATCCATCCGCAAATGGGTTTTACTCTTTTGAGTCGCCGAGGATAACTTCAGCGTCAA
TCTCTTCTGCTTTAGCATCGCAGTTTTCTTCGGTTAAAGTTGAAGATAATCCTTACAAATGG
GTTAATGTCAATGGTAATTGCTCTTCCTGGAATGATCTTTCTGCTTTCGGCTCTTCTCGTTG
A

SEQ ID NO: 218, Arabidopsis thaliana - protein - At2g37590
MVFSSIQAYLDSSNWQQAPPSNYNHDGTGASANGGHVLRPQLQPQQQPQQQPHPNGSGGGGG
GGGGSIRAGSMVDRARQANVALPEAALKCPRCESTNTKFCYFNNYSLTQPRHFCKTCRRYWT
RGGALRNVPVGGGCRRNRRTKSNSNNNNNSTATSNNTSFSSGNASTISTILSSHYGGNQESI
LSQILSPARLMNPTYNHLGDLTSNTKTDNNMSLLNYGGLSQDLRSIHMGASGGSLMSCVDEW
RSASYHQQSSMGGGNLEDSSNPNPSANGFYSFESPRITSASISSALASQFSSVKVEDNPYKW
VNVNGNCSSWNDLSAFGSSR

SEQ ID NO: 219, Arabidopsis thaliana - DNA
ATGGTTTTCTCATCTCTTCCAGTGAATCAGTTCGATTCCCAAAATTGGCAGCAGCAAGGGAA
CCAACATCAGCTAGAATGTGTCACAACTGACCAGAACCCTAATAATTACTTACGGCAGCTCT
CATCACCACCGACTTCTCAGGTTGCAGGTTCGAGTCAAGCTAGAGTGAATTCAATGGTGGAA
CGTGCTCGGATCGCAAAAGTCCCATTGCCTGAAGCAGCTCTAAATTGCCCTAGATGTGACTC
AACCAATACTAAGTTCTGTTACTTCAATAACTATAGCCTTACTCAACCTCGCCATTTCTGCA
AAACATGTCGTCGCTATTGGACACGTGGCGGTTCCTTGAGGAATGTTCCTGTTGGAGGAGGC
TTTAGGAGGAACAAGAGAAGCAAATCCAGATCGAAATCTACGGTCGTGGTCTCGACTGATAA
TACTACTAGTACTTCATCACTTACTTCTCGCCCAAGTTACTCAAACCCTAGCAAGTTTCATA
GCTACGGTCAAATCCCGGAGTTTAATTCCAACTTGCCCATCTTGCCTCCTCTCCAAAGCCTT
GGAGATTACAATTCAAGCAACACTGGATTAGATTTTGGTGGAACTCAAATAAGCAACATGAT
AAGTGGTATGAGTTCTAGTGGTGGGATCTTGGATGCATGGAGAATACCTCCATCACAACAAG
CTCAGCAATTCCCTTTCTTGATCAACACTACCGGATTGGTGCAATCTTCAAACGCGTTATAT
CCATTACTAGAAGGCGGGGTTAGCGCCACGCAAACAAGAAATGTGAAGGCGGAAGAGAATGA
TCAGGATCGGGGTAGGGATGGGGATGGAGTGAATAACTTATCAAGAAACTTTTTGGGTAATA
TCAACATAAACTCAGGCAGGAACGAGGAATACACATCATGGGGAGGTAACAGTTCTTGGACC
GGTTTCACCTCCAACAACTCAACAGGCCATCTCTCATTCTAA

FIGURE 28 (continued)

SEQ ID NO: 220, Arabidopsis thaliana - protein - At3g55370
MVFSSLPVNQFDSQNWQQQGNQHQLECVTTDQNPNNYLRQLSSPPTSQVAGSSQARVNSMVE
RARIAKVPLPEAALNCPRCDSTNTKFCYFNNYSLTQPRHFCKTCRRYWTRGGSLRNVPVGGG
FRRNKRSKSRSKSTVVVSTDNTTSTSSLTSRPSYSNPSKFHSYGQIPEFNSNLPILPPLQSL
GDYNSSNTGLDFGGTQISNMISGMSSSGGILDAWRIPPSQQAQQFPFLINTTGLVQSSNALY
PLLEGGVSATQTRNVKAEENDQDRGRDGDGVNNLSRNFLGNININSGRNEEYTSWGGNSSWT
GFTSNNSTGHLSF

SEQ ID NO: 221, Arabidopsis thaliana - DNA
ATGGTTTTTTCTTCATTTCCTACTTATCCTGATCATTCATCAAACTGGCAACAACAACATCA
ACCAATCACAACCACCGTTGGATTCACGGGAAATAACATCAACCAACAGTTTCTTCCTCACC
ATCCCCTCCCACCGCAACAGCAACAAACGCCTCCGCAGCTTCACCACAACAACGGTAACGGC
GGAGTCGCTGTTCCCGGTGGACCTGGCGGGTTAATCCGACCAGGTTCGATGGCGGAAAGAGC
AAGGCTAGCCAACATACCATTACCTGAAACAGCCTTGAAGTGTCCAAGATGTGACTCAACTA
ACACCAAATTCTGTTACTTCAACAACTACAGTCTCACTCAACCTCGCCACTTCTGCAAAGCA
TGCCGTCGTTACTGGACACGTGGCGGTGCTCTAAGGAGCGTTCCCGTCGGTGGCGGTTGCCG
TAGAAACAAAAGAACCAAAAACAGCAGCGGTGGAGGTGGCGGTAGCACCAGTAGCGGTAACA
GCAAGTCACAAGACAGCGCCACGAGCAACGACCAATACCACCACCGAGCCATGGCTAACAAT
CAGATGGGACCACCTTCTTCGTCATCGTCTCTAAGCTCGTTGCTGTCTTCTTACAACGCAGG
GTTAATCCCCGGACATGATCATAACAGCAATAACAACAACATACTTGGACTTGGATCATCTT
TGCCTCCTCTTAAGCTTATGCCTCCTTTAGACTTCACAGACAACTTCACCTTACAATACGGT
GCCGTTTCAGCTCCTTCTTATCATATAGGCGGTGGAAGCAGTGGAGGAGCGGCGGCTCTTTT
AAACGGTTTTGACCAGTGGAGATTCCCGGCAACAAACCAACTTCCTTTAGGCGGTTTAGACC
CGTTTGATCAACAACATCAAATGGAGCAGCAGAATCCAGGTTACGGATTGGTTACCGGGTCG
GGTCAGTATCGACCTAAGAACATTTTCCATAACCTTATCTCCTCTTCTTCGTCTGCTTCATC
AGCTATGGTTACAGCCACCGCGTCGCAATTAGCTTCAGTGAAAATGGAAGATAGTAACAATC
AGCTCAACTTGTCTAGACAACTTTTTGGAGACGAACAACAGCTCTGGAATATTCATGGCGCT
GCTGCAGCATCCACCGCAGCTGCAACAAGTTCGTGGAGTGAAGTCTCTAATAATTTCAGTTC
TTCTTCTACTAGCAATATATAA

SEQ ID NO: 222, Arabidopsis thaliana - protein - At5g02460
MVFSSFPTYPDHSSNWQQQHQPITTTVGFTGNNINQQFLPHHPLPPQQQQTPPQLHHNNGNG
GVAVPGGPGGLIRPGSMAERARLANIPLPETALKCPRCDSTNTKFCYFNNYSLTQPRHFCKA
CRRYWTRGGALRSVPVGGGCRRNKRTKNSSGGGGGSTSSGNSKSQDSATSNDQYHHRAMANN
QMGPPSSSSSLSSLLSSYNAGLIPGHDHNSNNNNILGLGSSLPPLKLMPPLDFTDNFTLQYG
AVSAPSYHIGGGSSGGAAALLNGFDQWRFPATNQLPLGGLDPFDQQHQMEQQNPGYGLVTGS
GQYRPKNIFHNLISSSSSASSAMVTATASQLASVKMEDSNNQLNLSRQLFGDEQQLWNIHGA
AAASTAAATSSWSEVSNNFSSSSTSNI

SEQ ID NO: 223, Artificial sequence - primer prm07315
GGGGACAAGTTTGTACAAAAAAGCAGGCTTAAACAATGGGTGGATCGATGGC

SEQ ID NO: 224, Artificial sequence - primer prm07316
GGGGACCACTTTGTACAAGAAAGCTGGGTCGTTAATGATCCGACAAAACA

FIGURE 28 (continued)

SEQ ID NO: 225, Oryza sativa - DNA - GOS2 promoter
AATCCGAAAAGTTTCTGCACCGTTTTCACCCCCTAACTAACAATATAGGGAACGTGTGCTAA
ATATAAAATGAGACCTTATATATGTAGCGCTGATAACTAGAACTATGCAAGAAAAACTCATC
CACCTACTTTAGTGGCAATCGGGCTAAATAAAAAGAGTCGCTACACTAGTTTCGTTTTCCT
TAGTAATTAAGTGGGAAAATGAAATCATTATTGCTTAGAATATACGTTCACATCTCTGTCAT
GAAGTTAAATTATTCGAGGTAGCCATAATTGTCATCAAACTCTTCTTGAATAAAAAAATCTT
TCTAGCTGAACTCAATGGGTAAAGAGAGAGATTTTTTTAAAAAAATAGAATGAAGATATTC
TGAACGTATTGGCAAAGATTTAAACATATAATTATATAATTTTATAGTTTGTGCATTCGTCA
TATCGCACATCATTAAGGACATGTCTTACTCCATCCCAATTTTTATTTAGTAATTAAAGACA
ATTGACTTATTTTATTATTTATCTTTTTTCGATTAGATGCAAGGTACTTACGCACACACTT
TGTGCTCATGTGCATGTGTGAGTGCACCTCCTCAATACACGTTCAACTAGCAACACATCTCT
AATATCACTCGCCTATTTAATACATTTAGGTAGCAATATCTGAATTCAAGCACTCCACCATC
ACCAGACCACTTTTAATAATATCTAAAATACAAAAAATAATTTTACAGAATAGCATGAAAAG
TATGAAACGAACTATTTAGGTTTTTCACATACAAAAAAAAAAAGAATTTTGCTCGTGCGCGA
GCGCCAATCTCCCATATTGGGCACACAGGCAACAACAGAGTGGCTGCCCACAGAACAACCCA
CAAAAAACGATGATCTAACGGAGGACAGCAAGTCCGCAACAACCTTTTAACAGCAGGCTTTG
CGGCCAGGAGAGAGGAGGAGAGGCAAAGAAAACCAAGCATCCTCCTCCTCCCATCTATAAAT
TCCTCCCCCCTTTTCCCCTCTCTATATAGGAGGCATCCAAGCCAAGAAGAGGGAGAGCACCA
AGGACACGCGACTAGCAGAAGCCGAGCGACCGCCTTCTTCGATCCATATCTTCCGGTCGAGT
TCTTGGTCGATCTCTTCCCTCCTCCACCTCCTCCTCACAGGGTATGTGCCCTTCGGTTGTTC
TTGGATTTATTGTTCTAGGTTGTGTAGTACGGGCGTTGATGTTAGGAAAGGGGATCTGTATC
TGTGATGATTCCTGTTCTTGGATTTGGGATAGAGGGGTTCTTGATGTTGCATGTTATCGGTT
CGGTTTGATTAGTAGTATGGTTTTCAATCGTCTGGAGAGCTCTATGGAAATGAAATGGTTTA
GGGTACGGAATCTTGCGATTTTGTGAGTACCTTTTGTTTGAGGTAAAATCAGAGCACCGGTG
ATTTTGCTTGGTGTAATAAAAGTACGGTTGTTTGGTCCTCGATTCTGGTAGTGATGCTTCTC
GATTTGACGAAGCTATCCTTTGTTTATTCCCTATTGAACAAAAATAATCCAACTTTGAAGAC
GGTCCCGTTGATGAGATTGAATGATTGATTCTTAAGCCTGTCCAAAATTTCGCAGCTGGCTT
GTTTAGATACAGTAGTCCCCATCACGAAATTCATGGAAACAGTTATAATCCTCAGGAACAGG
GGATTCCCTGTTCTTCCGATTTGCTTTAGTCCCAGAATTTTTTTCCCAAATATCTTAAAAA
GTCACTTTCTGGTTCAGTTCAATGAATTGATTGCTACAAATAATGCTTTTATAGCGTTATCC
TAGCTGTAGTTCAGTTAATAGGTAATACCCCTATAGTTTAGTCAGGAGAAGAACTTATCCGA
TTTCTGATCTCCATTTTTAATTATATGAAATGAACTGTAGCATAAGCAGTATTCATTTGGAT
TATTTTTTTATTAGCTCTCACCCCTTCATTATTCTGAGCTGAAAGTCTGGCATGAACTGTC
CTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAA
TCGGGATAGTTATACTGCTTGTTCTTATGATTCATTTCCTTTGTGCAGTTCTTGGTGTAGCT
TGCCACTTTCACCAGCAAAGTTC

SEQ ID NO: 226, Arabidopsis thaliana - DNA
ATGATGATGGAGACTAGAGATCCAGCTATTAAGCTTTTCGGTATGAAAATCCCTTTTCCGTC
GGTTTTTGAATCGGCAGTTACGGTGGAGGATGACGAAGAAGATGACTGGAGCGGCGGAGATG
ACAAATCACCAGAGAAGGTAACTCCAGAGTTATCAGATAAGAACAACAACAACTGTAACGAC
AACAGTTTTNACAATTCGAAACCCGAAACCTTGGACAAAGAGGAAGCGACATCAACTGATCA
GATAGAGAGTAGTGACACGCCTGAGGATAATCAGCAGACGACACCTGATGGTAAAACCCTAA
AGAAACCGACTAAGATTCTACCGTGTCCGAGATGCAAAAGCATGGAGACCAAGTTCTGTTAT
TACAACAACTACAACATAAACCAGCCTCGTCATTTCTGCAAGGCTTGTCAGAGATATTGGAC
TGCTGGAGGGACTATGAGGAATGTTCNTGTGGGGGCAGGACGTCGTAAGAACAAAAGCTTAT

FIGURE 28 (continued)

```
CTTCTCATTACCGTCACATCACTATTTCCGAGGCTCTTGAGGCTGCGAGGCTTGACCCGGGC
TTACAGGCAAACACAAGGGTCTTGAGTTTTGGTCTCGAAGCTCAGCAGCAGCACGTTGCTGC
TCCCATGACACCTGTGATGAAGCTACAAGAAGATCAAAAGGTCTCAAACGGTGCTAGGAACA
GGTTTCACGGGTTAGCGGATCAACGGCTTGTAGCTCGGGTAGAGAATGGAGATGATTGCTCA
AGCGGATCCTCTGTGACCACCTCTAACAATCACTCAGTGGATGAATCAAGAGCACAAAGCGG
CAGTGTTGTTGAAGCACAAATGAACAACAACAACAATAACATGAATGGTTATGCTTGCATCC
CAGGTGTTCCATGGCCTTACACGTGGAATCCAGCGATGCCTCCACCAGGTTTTTACCCGCCT
CCAGGGTATCCAATGCCGTTTTACCCTTACTGGACCATCCCAATGCTACCACCGCATCAATC
CTCATCGCCTATAAGCCAAAAGTGTTCAAATACAAACTCTCCGACTCTCGGAAAGCATCCGA
GAGATGAAGGATCATCGAAAAAGGACAACGAGACAGAGCGAAAACAGAAGGCCGGGTGCGTT
CTGGTCCCGAAAACGTTGAGAATAGATGATCCTAACGAAGCAGCAAAGAGCTCGATATGGAC
AACATTGGAATCAAGAACGAGGCGATGTGCAAAGCCGGTGGTATGTTCAAAGGGTTTGATC
ATAAGACAAAGATGTATAACAACGACAAAGCTGAGAACTCCCCTGTTCTTTCTGCTAACCCT
GCTGCTCTATCAAGATCACACAATTTCCATGAACAGATTTAG
```

SEQ ID NO: 227, Arabidopsis thaliana - protein
MMMETRDPAIKLFGMKIPFPSVFESAVTVEDDEEDDWSGGDDKSPEKVTPELSDKNNNNCND
NSFXNSKPETLDKEEATSTDQIESSDTPEDNQQTTPDGKTLKKPTKILPCPRCKSMETKFCY
YNNYNINQPRHFCKACQRYWTAGGTMRNVXVGAGRRKNKSLSSHYRHITISEALEAARLDPG
LQANTRVLSFGLEAQQQHVAAPMTPVMKLQEDQKVSNGARNRFHGLADQRLVARVENGDDCS
SGSSVTTSNNHSVDESRAQSGSVVEAQMNNNNNNMNGYACIPGVPWPYTWNPAMPPPGFYPP
PGYPMPFYPYWTIPMLPPHQSSSPISQKCSNTNSPTLGKHPRDEGSSKKDNETERKQKAGCV
LVPKTLRIDDPNEAAKSSIWTTLGIKNEAMCKAGGMFKGFDHKTKMYNNDKAENSPVLSANP
AALSRSHNFHEQI

SEQ ID NO: 228, Artificial sequence – protein – DOF domain
KPTKILPCPRCKSMETKFCYYNNYNINQPRHFCKACQRYWTAGGTMRNVXVGAGRRKNKSLS
S

SEQ ID NO: 229, Artificial sequence – protein – motif 1
KALKKPDKILP

SEQ ID NO: 230, Artificial sequence – protein – motif 2
DDPGIKLFGKTIPF

SEQ ID NO: 231, Artificial sequence – protein – motif 3
SPTLGKHSRDE

SEQ ID NO: 232, Artificial sequence – protein – motif 4
LQANPAALSRSQNFQE

SEQ ID NO: 233, Artificial sequence – protein – motif 5
KGEGCLWVPKTLRIDDPDEAAKSSIWTTLGIK

SEQ ID NO: 234, Oryza sativa - DNA
ATGAACAACGTTGAAGAGAAAGCAGCATCAGACTCAAAAGATGAAAATGAAAAGACAGCAAA
TGATGAATCAGGCCAGGACAAAGTACTTAAGAAGCCAGATAAGATTCTCCCTTGCCCTCGGT
GCAACAGTATGGACACAAAGTTTTGTTATTACAACAACTACAATGTTAATCAACCCAGGCAC
TTCTGTAAGAACTGCCAAAGGTATTGGACTGCCGGGGGAACCATGAGAAATGTACCTGTTGG
TGCTGGGAGGCGCAAAAGCAAGAGCTCATCGTTGCACTACCGTCACTTACTGATGGCCCCTG
ATTGCATGATGGGTCTAGAGTGGAAATATCCAAGTCAATGAACCCTGAAGCTTTCGCATCT
GCGCATTCGACCCCTATACAACCAATTGGCAGAAACGAAACAGTTCTCAAATTTGGGCCTGA
GGTGCCACTCTGTGAATCGATGGCATCAGTGCTGAACATTCAGGAGCAGAATGGAACCAATG
CTGCAGCAGTACCAACGGGTGAAAATCAGGAAGATAACTCTTGCATCTCTTCAATCACATCA
CACAACGTGTTACCTGAAAATGCAGCCCAAGTTGACAAGAACAGCACGCCGGTGTATTGCAA
CGGAGTCGGCCCAGTGCCGCAGTACTACCTTGGAGCTCCTTACATGTACCCATGGAACATAG
GATGGAACAACGTTCCTATGATGGTGCCAGGTACAAGCATGCCAGAGTCTGCTTCCCAATCT
GAGAGCTGCAGCACCAGTTCAGCTCCATGGATGAACATGAACTCCCCCATGATGCCGGTTGC
CTCGAGGCTTTCTGCACCACCATTTCCATACCCTCTAGTGCCACCTGCACTATGGGGTTGCT
TATCCAGCTGGCCGGCCACGGCATGGAACATACCGTGGATCAGAACGAATGGCGGCTGCATG
TCTCCATCGTCGTCGAGCAACAGCAGCTGTTCAGGCAATGGCTCCCCTCTGGGGAAGCATTC
CAGGGACTCCTCTCTCCCACTGAAGGAGGACAAGGAGGAGAAATCACTGTGGGTTCCCAAGA
CGCTCCGCATCGACGATCCCGACGAGGCGGCGAAGAGCTCCATCTGGGCCACCCTGGGGATC
AAGCCTGGAGACCCTGGCATCTTCAAGCCGTTCCAGTCCAAAGGTGAGAGCAAAGGCCAAGC
AGCATCAGAGACTCGTCCTGCTCGTGCTCTTAAGGCAAACCCAGCTGCATTGTCGCGGTCGC
AGTCGTTCCAGGAGACTTCTTGA

SEQ ID NO: 235, Oryza sativa - protein - NP_912875.1
MNNVEEKAASDSKDENEKTANDESGQDKVLKKPDKILPCPRCNSMDTKFCYYNNYNVNQPRH
FCKNCQRYWTAGGTMRNVPVGAGRRKSKSSSLHYRHLLMAPDCMMGSRVEISKSMNPEAFAS
AHSTPIQPIGRNETVLKFGPEVPLCESMASVLNIQEQNGTNAAAVPTGENQEDNSCISSITS
HNVLPENAAQVDKNSTPVYCNGVGPVPQYYLGAPYMYPWNIGWNNVPMMVPGTSMPESASQS
ESCSTSSAPWMNMNSPMMPVASRLSAPPFPYPLVPPALWGCLSSWPATAWNIPWIRTNGGCM
SPSSSSNSSCSGNGSPLGKHSRDSSLPLKEDKEEKSLWVPKTLRIDDPDEAAKSSIWATLGI
KPGDPGIFKPFQSKGESKGQAASETRPARALKANPAALSRSQSFQETS

SEQ ID NO: 236, Oryza sativa - DNA
ATGCCTAATTTAGGAAATGGTGTAAAAACCAATAATGACTTACCTTTAGTCTCAGACAAGCT
TTTGATTGTCAAAGGTATTCCTTTTGTCCCAACAATAGTAAGAAAAATGATTTACAAGGCA
TCAGCAGACCGGATGGAAGAATAGAAATCGATTCCATGACTGAGGATGTTAAGACTGAGCCT
GATGGATCTGTCCCTGAGAAGATACTCAAGAAGCCAGATAAGATTCTGCCATGTCCACGCTG
CAATAGCATGGAAACAAAGTTCTGCTACTTCAACAACTACAATGTTCACCAGCCCAGGCACT
TCTGCAGGAACTGCCAAAGATATTGGACCGCTGGTGGAGCTATGAGGAATGTCCCAGTTGGT
GCTGGAAGACGCAGAAATAAGCATGTGTCAAATACTGTCAGGCGATGATGACGTGCAATAA
TACTGTAGCTCCTGGAGATGTTTCTGATGTGGTTCACCATCAGGTTATTACACATGGATCTT
CTCTCCTTCCAGCAACACTGAAGGAAAATGAAACACCTACAGAATTCATATCAGAAGTACCA
CCATGTAAGTCTTCAGCTTCAATCCTTGATATTGGAGAGCCGAATGATACTGACCTTGTTCC
CTTGGCCTCTGGTGATAACAAGGAAGAAAAATCATGTGCATCTTCTGTGGTAGTATCCAGCT
GTTCAGAGAATCTGATGCCAGATAATGCAATTATGAAAGAGCCAAACAACAGGTCAGGATGT
TGTAATGGTGTGGCATTGCCTTTCCCTACTGGACCTGCTTGGTGCTCCCCTGGAGTCTTGG
ATGGAACAGTGTTGCTCTCATGCCAGCTACCCAGTGCTCGATGCAGCCCGTTCTTGGGTTAA FIGURE 28 (continued)

```
AAGATGGGATACCCTGCCCGCCTTCATGGCCACCGCAACTGATGGTGCCGGCCCCAGGAATC
TGTACTCCTGTTGTTCCAATCCCTCTTGTGCCACCTCTGTGGAGCTGCTTCCCTGGCTGGCC
TAATGGAATGTGGAATGCACAATGCCCTGGAGGTAATACTACTGTGCTGCCGTCAACCGCTC
CAAACAAAATTTCTTGTTCAGGAAGCAGTTCTCTGGTGTTGGGAAAGCATTCAAGAGAAGAA
AGCTTGCAGGAAGAAGAGAAGACGAGAAATTACTTATGGGTACCTAAAACTCTTAGGATTGA
TGATCCAGCTGAGGCTGCAAAGAGTTCAATCTGGGCGACCCTTGGCATCAAGCCTGACGATA
AAGGCATATTCAAGTCTTTCCAGCCAAATGTTGCGAAAAATGGCACGGCACCAGAATCGCCT
CAGGCTCTGCAGGCCAATCCAGCAGCATTTTCGCGTTCTCAATCGTTTCAAGAGACGACTTG
A
```

SEQ ID NO: 237, Oryza sativa - protein - NP_912989.1
```
MPNLGNGVKTNNDLPLVSDKLLIVKGIPFCPNNSKKNDLQGISRPDGRIEIDSMTEDVKTEP
DGSVPEKILKKPDKILPCPRCNSMETKFCYFNNYNVHQPRHFCRNCQRYWTAGGAMRNVPVG
AGRRRNKHVSKYCQAMMTCNNTVAPGDVSDVVHHQVITHGSSLLPATLKENETPTEFISEVP
PCKSSASILDIGEPNDTDLVPLASGDNKEEKSCASSVVVSSCSENLMPDNAIMKEPNNRSGC
CNGVALPFPTGPALVLPWSLGWNSVALMPATQCSMQPVLGLKDGIPCPPSWPPQLMVPAPGI
CTPVVPIPLVPPLWSCFPGWPNGMWNAQCPGGNTTVLPSTAPNKISCSGSSSLVLGKHSREE
SLQEEEKTRNYLWVPKTLRIDDPAEAAKSSIWATLGIKPDDKGIFKSFQPNVAKNGTAPESP
QALQANPAAFSRSQSFQETT
```

SEQ ID NO: 238, Oryza sativa - DNA
```
ATGGGAGGGGGTGGTAAGTGCAAAAGAGGGAAAAGAGGAAAGATTGCAGCCAAGCGAAGAAG
GGGCCAGTGTTGCAGCAGCAGCAGCAGCGGAGGCGCAAGAAGACGAGCTAGAGAGAGAG
AATCAGAGGAGAGCTTGGGTGAGATGGGTGAGTGCAGAGGAGGAGGAGGAGGAGGAGATGGG
CTGATCAAGCTGTTCGGGAAGACGATCCCGGTGCAGCCGGATGCCAAGGATGTTCAGCAGCA
TAGTGGCAGTAGCAGCAGCTCAACCGAATCCGACGTCCAAGAAACCGCCGCTGTCGCCGTCG
CCGACCCCTCCCCGCGGTCGGAGGTCGTCGACGGCGAGAGCCCGCCGCAGCCGGGCGGCGAG
GCGGCGAGCCATCAGCAGCAGCAGAAGGAGATGAAGCTGAAGAAGCCGGACAAGATCCTGCC
ATGCCCGCGGTGCAGCAGCATGGACACCAAGTTCTGCTACTTCAACAACTACAACGTCAACC
AGCCTCGCCACTTCTGCAAGCACTGCCAGCGCTACTGGACCGCCGGCGGCGCCATGCGCAAC
GTCCCCGTCGGCGCCGGCCGCCGCAAGAACAAGAACGCCACCGCCGCCGCCCACTTCCTCCA
CCGCGTCCGCGCCTGCGCCGCCGCCGCCGCCATGCCCGCGGCGCCCCACGACGCCACCAACG
CCACCGTGCTCAGCTTCGGCGGCGGCGGAGGCGGACACGACGCGCCGCCGGTCACCCTGGAC
CTCGCCGACAAGATGACGCGCCTCGGCAAGGAGGGCTCGTCGCCCATGCCCGGAACGCCGA
CGCCGCCGCCGCGTGCAGCGAGGTGTCGAGCAACAGGGACGACGAGCAGATCGGCAACACTG
TAGCAAAACCTGCAAACGGGTTGCAGCAGCATCCTCCTCCTCCTCATCATCATCATCATTCA
GCCATGAACGGTGGCGGCATCTGGCCCTACTACACCTCGGGGATCGCGATCCGATATACCC
GGCGGCGCCGGCGTACTGGGGCTGCATGATTCCACCTCCTGGAGCTTGGAGCCTCCCATGGC
CGGCCACAGTCCAGTCTCAGGCCATCTCATCATCATCACCACCTACAAGTGCTACACCTTCA
GTCTCCTCCTTCACACTAGGCAAGCATCCCAGAGAGGGTGGTGATCATGAGGCAAGAGATCA
CCATGGCAATGGTAAAGTGTGGGTGCCGAAGACGATCCGGATCGACAACGCCGACGAGGTTG
CCCGGAGCTCAATCCGGTCACTCTTCGCCTTCAGAGGCGGCGACAAGGCGGATGATAACAAC
GACGACGATGGCACCGGCGTGCACAAGCTCGCCACCACGGTGTTCGAGCCAAAGAGGGACAG
CAAGACGGCGAAACATCCGGCGATCACGAGCTTGCCGCTCTTGCACACCAACCCCGTCGCGC
TTACCCGATCCGCGACCTTCCAGGAGGGATCTTGA
```

FIGURE 28 (continued)

SEQ ID NO: 239, Oryza sativa – protein – AAK98677.1
MGGGGKCKRGKRGKIAAKRRRGQCCSSSSSSGGARRRARERESEESLGEMGECRGGGGGGDG
LIKLFGKTIPVQPDAKDVQQHSGSSSSSTESDVQETAAVAVADPSPRSEVVDGESPPQPGGE
AASHQQQQKEMKLKKPDKILPCPRCSSMDTKFCYFNNYNVNQPRHFCKHCQRYWTAGGAMRN
VPVGAGRRKNKNATAAAHFLHRVRACAAAAAMPAAPHDATNATVLSFGGGGGGHDAPPVTLD
LADKMTRLGKEGLVAHARNADAAAACSEVSSNRDDEQIGNTVAKPANGLQQHPPPPHHHHHS
AMNGGGIWPYYTSGIAIPIYPAAPAYWGCMIPPPGAWSLPWPATVQSQAISSSSPPTSATPS
VSSFTLGKHPREGGDHEARDHHGNGKVWVPKTIRIDNADEVARSSIRSLFAFRGGDKADDNN
DDDGTGVHKLATTVFEPKRDSKTAKHPAITSLPLLHTNPVALTRSATFQEGS

SEQ ID NO: 240, Oryza sativa – DNA
ATGGGAGGGGGTGGTAAGTGCAAAAGAGGGAAAAGAGGAAAGATTGCAGCCAAGCGAAGAAG
GGGCCAGTGTTGCAGCAGCAGCAGCAGCGGAGGCGCAAGAAGACGAGCTAGAGAGAGAG
AATCAGAGGAGAGCTTGGGTGAGATGGGTGAGTGCAGAGGAGGAGGAGGAGGAGGAGATGGG
CTGATCAAGCTGTTCGGGAAGACGATCCCGGTGCAGCCGGATGCCAAGGATGTTCAGCAGCA
TAGTGGCAGTAGCAGCAGCTCAACCGAATCCGACGTCCAAGAAACCGCCGCTGTCGCCGTCG
CCGACCCCTCCCCGCGGTCGGAGGTCGTCGACGGCGAGAGCCCGCCGCAGCCGGGCGGCGAG
GCGGCGAGCCATCAGCAGCAGCAGAAGGAGATGAAGCTGAAGAAGCCGGACAAGATCCTGCC
ATGCCCGCGGTGCAGCAGCATGGACACCAAGTTCTGCTACTTCAACAACTACAACGTCAACC
AGCCTCGCCACTTCTGCAAGCACTGCCAGCGCTACTGGACCGCCGGCGGCGCCATGCGCAAC
GTCCCCGTCGGCGCCGGCCGCCGCAAGAACAAGAACGCCACCGCCGCGCCCACTTCCTCCA
CCGCGTCCGCGCCTGCGCCGCCGCCGCCATGCCCGCGGCGCCCCACGACGCCACCAACG
CCACCGTGCTCAGCTTCGGCGGCGGCGGAGGCGGACACGACGCGCCGCCGGTCACCCTGGAC
CTCGCCGACAAGATGACGCGCCTCGGCAAGGAGGGGCTCGTCGCCCATGCCCGGAACGCCGA
CGCCGCCGCCGCGTGCAGCGAGGTGTCGAGCAACAGGGACGACGAGCAGATCGGCAACACTG
TAGCAAAACCTGCAAACGGGTTGCAGCAGCATCCTCCTCCTCCTCATCATCATCATCATTCA
GCCATGAACGGTGGCGGCATCTGGCCCTACTACACCTCGGGGATCGCGATCCCGATATACCC
GGCGGCGCCGGCGTACTGGGGCTGCATGATTCCACCTCCTGGAGCTTGGAGCCTCCCATGGC
CGGCCACAGTCCAGTCTCAGGCCATCTCATCATCATCACCACCTACAAGTGCTACACCTTCA
GTCTCCTCCTTCACACTAGGCAAGCATCCCAGAGAGGGTGGTGATCATGAGGCAAGAGATCA
CCATGGCAATGGTAAAGTGTGGGTGCCGAAGACGATCCGGATCGACAACGCCGACGAGGTTG
CCCGGAGCTCAATCCGGTCACTCTTCGCCTTCAGAGGCGGCGACAAGGCGGATGATAACAAC
GACGACGATGGCACCGGCGTGCACAAGCTCGCCACCACGGTGTTCGAGCCAAAGAGGGACAG
CAAGACGGCGAAACATCCGGCGATCACGAGCTTGCCGCTCTTGCACACCAACCCCGTCGCGC
TTACCCGATCCGCGACCTTCCAGGAGGGATCTTGA

SEQ ID NO: 241, Oryza sativa – protein – XP_470300.1
MGECKVGGGGGGGDCLIKLFGKTIPVPEPGACAAGDVDKDLQHSGSSTTEPKTQENTVQDST
SPPPQPEVVDTEDSSADKNSSENQQQQGDTANQKEKLKKPDKILPCPRCSSMDTKFCYYNNY
NINQPRHFCKNCQRYWTAGGAMRNVPVGAGRRKSKSVSAASHFLQRVRAALPGDPPLYAPVK
TNGTVLSFGSDLSTLDLTEQMKHLKDKFIPTTGIKNTDEMPVGLCAEGLSKTEESNQTNLKE
KVSADRSPNVAQHPCMNGGAMWPFGVAPPPAYYTSSIAIPFYPAAAAVAAYWGCMVPGAWN
APWPPQSQSQSVSSSSAASPVSTMTNCFRLGKHPRDGDEELDSKGNGKVWVPKTVRIDDVDE
VARSSIWSLIGIKGDKVGADHGRGCKLAKVFESKDEAKASTHTAISSLPFMQGNPAALTRSV
TFQEGS FIGURE 28 (continued)

SEQ ID NO: 242, Oryza sativa - DNA
ACTTGTCGGATCTCTCTCTCTCTCTCTCTCCCTCTCTCTCGCCCATGTACCATCTCCA
TGGACGACCTCGCCGCCGCCTCCCCTCCTCACCCGCCGCCGCCGCCGGAATCCCACGTG
CCTCCGCCCCCGCAGACGCCGGAGAAGGATTCATGTGAGGATACAGGAGACATGAGGATCAG
TGAAGAAAAGCCATGCACAGATCAGGAGTTAGATGCTGATCAGATGAATAGTTCTAGCTTTA
ATAGTTCCAGCGAGTGTGAGAATCAAACACCTAGCAATGATGAAATGACTGGATCAGAGTCC
AAATCTGAGGCAGCTCAAACAGAGGGTGGTGGATCGAGTGAAGAGAAGGTCCTGAAGAAGCC
AGACAAGATCCTGCCTTGTCCTCGTTGCAACAGCATGGATACAAAGTTCTGCTACTACAACA
ACTACAACATTAACCAGCCAAGACATTTTTGCAAGAGTTGTCAGAGATATTGGACGGCAGGT
GGAAGCATGAGGAACCTCCCTGTTGGTGCTGGTAGGCGCAAGAGTAAGAGCTCCACTGCAAA
TTACCGCAGTATATTAATCACGGGCAGCAATCTAGCTGCTCCTGCTGGAGATGCTCCCCTCT
ATCAACTCTCTATAAAAGGAGATCAAACAGCAACGGCAGTTAAATTTGCACCTGATTCCCCA
CTCTGTAATTCCATGGCCTCTGTGCTGAAAATTGGAGAGCAGAGTAAGAATGCCAAGCCTAC
CTCAACAGCACAACCCAGAAATGGAGAAACCCAGACCTGCCCGGCTTCAGGAACAACTTCAG
ATAGTCCCCGGAATGAACCAGTTAATGGAGCAGTTAGTGGGCATCAAAATGGAATTGTTGGG
CATAGTGGAGTCCCTCCCATGCATCCCATACCATGCTTCCCTGGTCCTCCTTTTGTGTACCC
ATGGAGTCCAGCATGGAATGGCATTCCTGCCATGGCACCACCGGTATGCACAGCACCAGCTG
AACCAGCAAATTCTTCAGACAATGGAAGCACAGCTAGTGTTCAGTGGAGCATGCCACCAGTG
ATGCCGGTACCAGGATACTTTCCGGTAATTCCATCTTCAGTTTGGCCCTTCATTTCTCCCTG
GCCAAATGGTGCATGGAGCTCGCCATGGATTCAACCTAATTGCAGCGTGTCAGCTTCATCTC
CTACAAGCACTAGTACATGTTCAGACAACGGCTCTCCTGTCCTAGGAAAGCACTCCAGGGAC
TCCAAACCGCAAGGAGATGACAAGGCAGAGAAAACTTGTGGATTCCGAAAACGCTTCGGAT
CGATGATCCTGACGAAGCTGCAAAGAGCTCAATCTGGACAACCCTTGGCATTGAACCTGGTG
ACCGTAGCATGTTCAGATCATTCCAGTCGAAACCTGAAAGCAGGGAGCAGATATCCGGTGCT
GCACGAGTCCTGCAGGCGAATCCAGCAGCTCTATCTCGATCTCAATCTTTCCAGGAGACAAC
GTGATGTATATTGAAGAAATCGTGTGACAATTGTAGAACATGTTACTACTATAATTTAAGCA
AGTGCTACAGCCTGAAGGATGATTGGCGATGTAGGCGCTGCTGCAAACATGGAGGCAGCGTG
ATCTGTACTATTGAAACCTGAAGAGTACTATTCTTGACATTTTTCTATAATTTGCCTGTGGA
GCATGCACCAGTCTACTGGGTTCATGATCAGGCTGTCAGCATATGTTTTGTTGTACAATAAT
AATAATTGTTAATAGCTTTGCCTAAAGGATACTGATAGTATTCTGCTGATCCTTCAGCTCTG
TGATC

SEQ ID NO: 243, Oryza sativa - XP_479581.1
MDDLAAASPPHPPPPPPESHVPPPPQTPEKDSCEDTGDMRISEEKPCTDQELDADQMNSSSF
NSSSECENQTPSNDEMTGSESKSEAAQTEGGGSSEEKVLKKPDKILPCPRCNSMDTKFCYYN
NYNINQPRHFCKSCQRYWTAGGSMRNLPVGAGRRKSKSSTANYRSILITGSNLAAPAGDAPL
YQLSIKGDQTATAVKFAPDSPLCNSMASVLKIGEQSKNAKPTSTAQPRNGETQTCPASGTTS
DSPRNEPVNGAVSGHQNGIVGHSGVPPMHPIPCFPGPPFVYPWSPAWNGIPAMAPPVCTAPA
EPANSSDNGSTASVQWSMPPVMPVPGYFPVIPSSVWPFISPWPNGAWSSPWIQPNCSVSASS
PTSTSTCSDNGSPVLGKHSRDSKPQGDDKAEKNLWIPKTLRIDDPDEAAKSSIWTTLGIEPG
DRSMFRSFQSKPESREQISGAARVLQANPAALSRSQSFQETT

SEQ ID NO: 244, Hordeum vulgare - DNA
CTAGACATGATTGCCAAGCTCGAAAATAACCCTCACAAAGGGAACAAAACTGGTACCGGGCC
CCCCCTCGAGGTCGACAAGGTCGGTGTCCATGCCCCTCCCCCTCCTCCTTTGTGTTCTTGT
GTATGAAATCCCGGGAATTTTGATTGGTTTCTAATAGAGCCTGTGAAAAAAAAAAGGCCAT
TTCGAGGCCTGCTTTCTTTGGCTTTGGAGCCGATCATGGCGACGAGTCGTGTTTGGTCTAGT FIGURE 28 (continued)

CATCAGGTCTTAAGCATGGAGTTCCCTGCCTGTTTTGGGAGGTACTAGTAAGCGCTAAGCAG
GCAGGTTTAGCTTCCATTAGCAAGGGAATTTCGCCTTTGCTGGTCTCTAATAATAATAGCAG
TTTCAACAGTTTTAGTATTGCATGATCTAGTCGTCTGAACATCTGGACTTCTGAAAGACAGG
CCTTTCTAGGTTATTATCTTGCCTCTTTTAATAGGTCGTTTTCGCGTGCTCCCAAGGATTTT
GCTGAAAGTGGCTACTGATATGTGTTGCCGTAACCTACTGGACTTCAGAAGTTCAGATGCGT
CCGACTCTGAGTACATCACCCACTGCAAATCAAAGCACCATAGCTTCTTTTTTTCATTAACA
AGATATAAGAACTGGGAATATGAACAAACTTTGTCAAATTTTACACTTGGGTCAGATGGGGG
AAAGCATGTTGTAATCACCGGTCAATAACCCGAATATTACACCGTGTTTGTGGACCTCTAAT
TCACAACAAAATTATTTCAAAGTTAGACTATATATATATACAAGGAACTCATCGAGATTTTC
TGAATGTTTACAGGACCTTCAGCACAGAGGAAGCACCACGGCTGAACCGAAAGTACAAGAAA
GCGCCCCACAGGACTCCACGGGCTCGCCTCCGCAGCCGGAGGTTGTGGACGTCGAGGATCCA
TCTGCTGTCAAGAACTCAGCAGCAGATCAACAAGAAGAAGAAGAAGAACAGGGTGACACGGC
CAACCAGAAGGAGAAGCTCAAGAAGCCTGACAAGATCCTGCCCTGCCCACGCTGTAGCAGCA
TGGACACCAAGTTCTGCTACTACAACAACTACAACATCAACCAGCCGCGCCACTTCTGCAAG
AACTGCCAGAGGTACTGGACGGCCGGCGGGCCATGCGCAACGTGCCCGTGGGCGCGGGCCG
CCGCAAGAGCAAGAGCATATCGGCAGCGTCCCACTTCCTTCAGAGGATAAGGGCCGCTCTGC
CCGGTGATCCTCTCTGCACCCCGGTCAACACTAACGGCACGGTGCTCAGCTTCGGCTCCGAC
GCATCCACCTTGGACGTCGTCTCAGAACAGATGAAGCACATGAAGGAGCTCAGCTCAGTAAC
CCGGACCGAGAACACCGATGCCCCGTCAGTAGGGTCTTGTGCTGAAGGATGGGCAAAGGGAG
AAGAGTCGAGCCAGATGAACTCGAGGGAGAGAGTTGCAGCAGATAGATCGCCAAATTTTGCG
CAGCACCCGTGCATGAACGGGGCAGCCATGTGGCCATTCAGTTGTGCACCATCGCCTGCCTA
TTTCACCCCAAACGTAGCAATTCCATTCTATCCAGCTGCTGCTGCTGCCTACTGGGGCTGCA
TGGTTCCGGGAGCCTGGAACACTCCATGGCAGCCGCAGCCGCAGCCGCAGTCTCAGTGTCAA
TCTAGCTCACCACCTAGTGCCGCTTCTCCGGTATCAACAATGTCCAGTTGCTTCCAATCCCG
GAAGCATCCTAGAGATGGTGATGAGGAAAGAGATACCAAGGGTAATGGCAAGGTGTGGGTGC
CCAAGACGATCGAGTCGAC

SEQ ID NO: 245, Hordeum vulgare - protein - CAC85949 (partial)
LKKPDKILPCPRCSSMDTKFCYYNNYNINQPRHFCKNCQRYWTAGGAMRNVPVGAGRRKSKS
ISAASHFLQRIRAALPGDPLCTPVNTNGTVLSFGSDASTLDVVSEQMKHMKELSSVTRTENT
DAPSVGSCAEGWAKGEESSQMNSRERVAADRSPNFAQHPCMNGAAMWPFSCAPSPAYFTPNV
AIPFYPAAAAAYWGCMVPGAWNTPWQPQPQPQSQCQSSSPPSAASPVSTMSSCFQSRKHPRD
GDEERDTKGNGKVWVPKTIEST

SEQ ID NO: 246, Cucurbita maxima - DNA
CAGCTGCAAAAGAGGAAACTCTTCATGATTCAGAGGATTATGCATGTGTAAAAACAGCAAAT
GAGGCGCACATGAATCCTGAAGTGTTATCAACAGATGAAAATGATAAGCTCGCAACAAGGAA
AACTGAGAAAGAACAGAATGATGCCCCCAACTCGAAAGAGAAACTGAAGAAACCAGATAAGA
TACTTCCATGTCCCCGCTGCAATAGCATGGAAACCAAGTTTTGTTATTATAATAATTATAAT
GTCAATCAACCACGCCATTTTTGCAAAGCCTGTCAAAGATATTGGACTGAAGGCGGTACCAT
CAGGAATGTCCCTGTTGGAGCTGGCCGCCGAAAAACAAGAACTCAGCCTCACACTACCGAC
ACATTACAATCTCAGAGGCTCTCCGAGCTGCACAAATTGATGTTCCTATTGAGGTCAACCAC
CTAGCATCAAAAGGCAATGGACGAGTCCTCAATTTCAGTGTAAGCCCACCTGTATGTGAATC
TATGGTCAATGTATCACATCCTGCAGAAAGAAAGGTCTTGAATGGAACAAGGAATGAATTTG
AGGGAGCCAAAGGACCTTGTGAGGGTGGGAAACTGGTGATGATTGTTCTAGTGCATCTTCA
GTAACAATGTCAAGCTCAATGAAGAATGGAGCCAGGAGGTTCCCTCAAGAACCACATATGCA
GAACATCAATGGTTTTCCTTCTCAAATCCCATGTCTTCCTGGTGTTCCTTGGCCTTGTTCAT

```
GGACTGCACCAATACCTCCACCAGCCTTGTGCCCTCCTGGAGTTCCTTTATCATTCTACCCT
GCAACATATTGGAGTTGCAGTGCTTCAGGTTCTTGGAATATTCCTTGGGTCACTCCACAACC
CTGTCCTCCAATCCCTGGTCCAAATTCTCCGACGCTAGGCAAGCATTCGAGAGATGGCGATG
AACTCCAGGCTGATAATTCTGAGATGAAAGATCCTCCAAAACAGAAAAATGGATCTGTTTTG
GTTCCCAAAACTTTAAGGATTGATGATCCAAACGAAGCTGCTAAGAGTTCAATATGGGAGAC
ACTTGGTATTAAGAATGATTCAATCAAAGCTGTTGATCTGTCTAATGTTTTCCAATCAAAGG
GCGACCTAAAGAGTAACGTTTCTGAAGTGTTGTCTCCAGTTTTGCAAGCCAACCCTGCAGCC
TTGTCAAGATCTCTTACTTTCCACGAGCGGTCGTGAATGGTATTTTTGATTTTCCAGGTTCA
TTGTAAAAGAAATCTTTAAGTTAAGAAGCTTAAGCATGAAGTGGATACAAGCATCAATCTCA
AGCTTCTTCTGCTCAAGAAGCAATCCAGTTTTTCAAGAATCCCGGAATTGTTCTCTCTATAG
AAAGAGTAGCTGCCATTATCAAGCCATCCTTTTGTACATAACTTTACATATGTGAATAACCG
ATGTAGAGTGGCAGCTAAAGATTCTCAGATGTATAAAAATGCAGCCAAAAGTTTGCTTC
```

SEQ ID NO: 247, Cucurbita maxima - BAA08094
MNPEVLSTDENDKLATRKTEKEQNDAPNSKEKLKKPDKILPCPRCNSMETKFCYYNNYNVNQ
PRHFCKACQRYWTEGGTIRNVPVGAGRRKNKNSASHYRHITISEALRAAQIDVPIEVNHLAS
KGNGRVLNFSVSPPVCESMVNVSHPAERKVLNGTRNEFEGAKGPCEGGETGDDCSSASSVTM
SSSMKNGARRFPQEPHMQNINGFPSQIPCLPGVPWPCSWTAPIPPPALCPPGVPLSFYPATY
WSCSASGSWNIPWVTPQPCPPIPGPNSPTLGKHSRDGDELQADNSEMKDPPKQKNGSVLVPK
TLRIDDPNEAAKSSIWETLGIKNDSIKAVDLSNVFQSKGDLKSNVSEVLSPVLQANPAALSR
SLTFHERS

SEQ ID NO: 248, Arabidopsis thaliana - DNA
```
ATGTGGCTCTCTCATCTCTTCATGTCCCTCTCTAAGCTGACGTGTAATTTCTCCATTTTCTC
TGTCTTTATGGCTTGTGGCTCTATTGGTATGTCTCAAGTTAGAGATACTCCGGTTAAATTGT
TTGGCTGGACAATTACACCGGTTTCTCATGATCCATACTCTTCTTCGTCCCATGTTCTTCCT
GATTCTTCCTCGTCTTCCTCGTCTTCTTCTATCACTTCGACCACACATGATGAATAACCA
ATCTGTTACTGACAATACAAGTCTTAAGCTGTCATCTAATCTTAACAACGAGTCAAAAGAAA
CATCTGAGAACAGTGATGACCAACACAGCGAGATCACAACAATTACATCGGAAGAAGAGAAA
ACAACTGAACTGAAGAAACCAGACAAGATTCTTCCATGTCCGAGATGCAACAGCGCAGACAC
CAAATTCTGTTACTACAACAACTACAACGTTAACCAGCCACGTCACTTCTGTAGAAAATGCC
AGAGGTATTGGACCGCTGGTGGATCCATGAGGATCGTCCCGGTTGGCTCAGGCCGTCGCAAG
AACAAGGGATGGGTTTCTTCAGACCAGTACCTGCACATCACTTCCGAGGATACTGACAATTA
CAATAGCTCCTCAACAAAGATTCTAAGCTTCGAGTCTTCGGACTCTTTGGTAACTGAGAGGC
CTAAGCATCAATCAAACGAAGTGAAGATAAACGCTGAACCTGTTTCACAAGAACCCAACAAC
TTCCAAGGGTTACTTCCTCCCCAAGCATCCCCTGTTTCGCCTCCTTGGCCTTACCAATACCC
TCCAAACCCTAGTTTCTACCACATGCCCGTCTACTGGGGCTGCGCGATACCGGTTTGGTCTA
CCCTCGACACTTCTACATGTCTTGGGAAAAGGACAAGAGACGAAACTTCTCATGAAACTGTT
AAAGAGAGTAAAAATGCTTTTGAGAGAACAAGCTTGCTTTTGGAATCTCAGAGCATCAAAAA
TGAAACAAGTATGGCTACAAATAACCATGTGTGGTATCCAGTACCGATGACCCGCGAGAAGA
CACAAGAATTCAGCTTTTTCAGTAATGGAGCTGAAACAAAGAGCAGCAACAACAGATTCGTC
CCTGAAACGTATCTTAACCTGCAAGCAAACCCTGCAGCCATGGCAAGATCTATGAACTTCAG
AGAGAGCATATAA
```

FIGURE 28 (continued)

SEQ ID NO: 249, Arabidopsis thaliana - protein - At1g26790
MWLSHLFMSLSKLTCNFSIFSVFMACGSIGMSQVRDTPVKLFGWTITPVSHDPYSSSSHVLP
DSSSSSSSSSLSLRPHMMNNQSVTDNTSLKLSSNLNNESKETSENSDDQHSEITTITSEEEK
TTELKKPDKILPCPRCNSADTKFCYYNNYNVNQPRHFCRKCQRYWTAGGSMRIVPVGSGRRK
NKGWVSSDQYLHITSEDTDNYNSSSTKILSFESSDSLVTERPKHQSNEVKINAEPVSQEPNN
FQGLLPPQASPVSPPWPYQYPPNPSFYHMPVYWGCAIPVWSTLDTSTCLGKRTRDETSHETV
KESKNAFERTSLLLESQSIKNETSMATNNHVWYPVPMTREKTQEFSFFSNGAETKSSNNRFV
PETYLNLQANPAAMARSMNFRESI

SEQ ID NO: 250, Arabidopsis thaliana - DNA
ATGTCTAAATCTAGAGATACGGAGATAAAGTTGTTTGGGAGGACAATCACATCTCTTTTAGA
TGTGAATTGTTATGATCCGTCGTCGTTGTCCCTGTTCACGATGTTTCTTCTGATCCAAGCA
AGGAGGATTCGTCTTCTTCTTCATCTTCTTGTTCTCCAACTATTGGACCAATCAGGGTTCCG
GTTAAAAAAAGTGAGCAAGAGAGTAACAAATTCAAAGATCCATATATATTATCCGATCTAAA
CGAACCACCAAAAGCAGTATCTGAGATTTCATCACCAAGAAGTTCCAAGAACAACTGTGATC
AACAGAGCGAGATCACAACAACAACTACCACAAGTACTACATCAGGAGAGAAATCAACGGCT
CTCAAGAAACCGGACAAGCTTATTCCATGTCCTAGATGTGAAAGCGCAAACACCAAATTCTG
TTATTACAACAACTACAACGTGAACCAGCCACGTTACTTCTGCAGGAACTGTCAGAGGTATT
GGACAGCTGGTGGATCTATGAGGAACGTTCCTGTTGGCTCAGGTCGTCGCAAGAACAAAGGA
TGGCCTTCTTCAAACCATTACTTGCAAGTCACTTCTGAGGATTGTGATAATAATAACTCGGG
GACGATCCTTAGTTTCGGTTCTTCGGAGTCTTCGGTTACAGAGACTGGTAAGCATCAGTCAG
GTGATACAGCAAAGATAAGTGCTGATTCAGTTTCTCAAGAAAATAAAAGCTACCAAGGGTTT
CTTCCTCCGCAAGTAATGTTACCTAATAATTCTTCTCCTTGGCCTTACCAATGGAGTCCAAC
GGGTCCTAACGCTAGTTTCTACCCTGTCCCCTTCTACTGGGGATGCACGGTTCCGATATACC
CTACCTCAGAGACTTCATCATGTTTAGGAAAACGGTCAAGAGATCAAACTGAAGGAAGAATC
AATGATACTAATACAACAATAACTACTACAAGAGCAAGATTGGTCTCAGAATCTCTTAGAAT
GAATATCGAAGCTAGTAAGAGCGCTGTGTGGTCTAAGTTACCGACAAAACCCGAGAAAAAAA
CGCAAGGATTCAGTTTGTTCAATGGATTTGACACAAAGGGAAACAGCAACAGAAGTAGCTTG
GTCTCCGAAACTTCTCACAGTCTACAAGCAAACCCTGCAGCGATGTCTAGAGCTATGAACTT
CAGGGAGAGCATGCAACAATAA

SEQ ID NO: 251, Arabidopsis thaliana - protein - At1g69570
MSKSRDTEIKLFGRTITSLLDVNCYDPSSLSPVHDVSSDPSKEDSSSSSSSCSPTIGPIRVP
VKKSEQESNKFKDPYILSDLNEPPKAVSEISSPRSSKNNCDQQSEITTTTTTSTTSGEKSTA
LKKPDKLIPCPRCESANTKFCYYNNYNVNQPRYFCRNCQRYWTAGGSMRNVPVGSGRRKNKG
WPSSNHYLQVTSEDCDNNNSGTILSFGSSESSVTETGKHQSGDTAKISADSVSQENKSYQGF
LPPQVMLPNNSSPWPYQWSPTGPNASFYPVPFYWGCTVPIYPTSETSSCLGKRSRDQTEGRI
NDTNTTITTTRARLVSESLRMNIEASKSAVWSKLPTKPEKKTQGFSLFNGFDTKGNSRSSL
VSETSHSLQANPAAMSRAMNFRESMQQ

SEQ ID NO: 252, Arabidopsis thaliana - DNA
ATGATGATGGAGACTAGAGATCCAGCTATTAAGCTTTTCGGTATGAAAATCCCTTTTCCGTC
GGTTTTTGAATCGGCAGTTACGGTGGAGGATGACGAAGAAGATGACTGGAGCGGCGGAGATG
ACAAATCACCAGAGAAGGTAACTCCAGAGTTATCAGATAAGAACAACAACAACTGTAACGAC
AACAGTTTTAACAATTCGAAACCCGAAACCTTGGACAAAGAGGAAGCGACATCAACTGATCA
GATAGAGAGTAGTGACACGCCTGAGGATAATCAGCAGACGACACCTGATGGTAAAACCCTAA
AGAAACCGACTAAGATTCTACCGTGTCCGAGATGCAAAAGCATGGAGACCAAGTTCTGTTAT FIGURE 28 (continued)

```
TACAACAACTACAACATAAACCAGCCTCGTCATTTCTGCAAGGCTTGTCAGAGATATTGGAC
TGCTGGAGGGACTATGAGGAATGTTCCTGTGGGGGCAGGACGTCGTAAGAACAAAAGCTCAT
CTTCTCATTACCGTCACATCACTATTTCCGAGGCTCTTGAGGCTGCGAGGCTTGACCCGGGC
TTACAGGCAAACACAAGGGTCTTGAGTTTTGGTCTCGAAGCTCAGCAGCAGCACGTTGCTGC
TCCCATGACACCTGTGATGAAGCTACAAGAAGATCAAAAGGTCTCAAACGGTGCTAGGAACA
GGTTTCACGGGTTAGCGGATCAACGGCTTGTAGCTCGGGTAGAGAATGGAGATGATTGCTCA
AGCGGATCCTCTGTGACCACCTCTAACAATCACTCAGTGGATGAATCAAGAGCACAAAGCGG
CAGTGTTGTTGAAGCACAAATGAACAACAACAACAACAATAACATGAATGGTTATGCTTGCA
TCCCAGGTGTTCCATGGCCTTACACGTGGAATCCAGCGATGCCTCCACCAGGTTTTTACCCG
CCTCCAGGGTATCCAATGCCGTTTTACCCTTACTGGACCATCCCAATGCTACCACCGCATCA
ATCCTCATCGCCTATAAGCCAAAAGTGTTCAAATACAAACTCTCCGACTCTCGGAAAGCATC
CGAGAGATGAAGGATCATCGAAAAAGGACAACGAGACAGAGCGAAAACAGAAGGCCGGGTGC
GTTCTGGTCCCGAAAACGTTGAGAATAGATGATCCTAACGAAGCAGCAAAGAGCTCGATATG
GACAACATTGGGAATCAAGAACGAGGCGATGTGCAAAGCCGGTGGTATGTTCAAAGGGTTTG
ATCATAAGACAAAGATGTATAACAACGACAAAGCTGAGAACTCCCCTGTTCTTTCTGCTAAC
CCTGCTGCTCTATCAAGATCACACAATTTCCATGAACAGATTTAG
```

SEQ ID NO: 253, Arabidopsis thaliana – protein – At3g4750
MMMETRDPAIKLFGMKIPFPSVFESAVTVEDDEEDDWSGGDDKSPEKVTPELSDKNNNNCND
NSFNNSKPETLDKEEATSTDQIESSDTPEDNQQTTPDGKTLKKPTKILPCPRCKSMETKFCY
YNNYNINQPRHFCKACQRYWTAGGTMRNVPVGAGRRKNKSSSSHYRHITISEALEAARLDPG
LQANTRVLSFGLEAQQQHVAAPMTPVMKLQEDQKVSNGARNRFHGLADQRLVARVENGDDCS
SGSSVTTSNNHSVDESRAQSGSVVEAQMNNNNNNMNGYACIPGVPWPYTWNPAMPPPGFYP
PPGYPMPFYPYWTIPMLPPHQSSSPISQKCSNTNSPTLGKHPRDEGSSKKDNETERKQKAGC
VLVPKTLRIDDPNEAAKSSIWTTLGIKNEAMCKAGGMFKGFDHKTKMYNNDKAENSPVLSAN
PAALSRSHNFHEQI

SEQ ID NO: 254, Arabidopsis thaliana – DNA
```
ATGGCTGATCCGGCGATTAAGCTCTTTGGAAAGACGATTCCTTTACCTGAGCTTGGTGTTGT
TGATTCTTCTTCTAGCTATACCGGATTTTTAACCGAAACTCAGATTCCTGTTCGGTTATCAG
ATTCGTGTACCGGCGATGATGATGATGAAGAGATGGGTGATTCCGGTTAGGACGAGAAGAA
GGTGATGATGTTGGTGATGGTGGAGGAGAGAGCGAGACTGATAAAAAGGAAGAAAAAGATAG
TGAGTGTCAGGAAGAGTCATTGAGGAATGAATCTAATGATGTTACTACTACTACATCGGGTA
TAACTGAAAAAACGGAAACAACAAAAGCTGCAAAGACGAATGAAGAGTCAGGTGGTACTGCT
TGCTCTCAAGAGGGGAAGTTAAAGAAACCTGATAAGATTCTACCGTGTCCGCGATGTAACAG
CATGGAAACCAAGTTCTGTTACTACAACAACTATAATGTTAACCAACCTCGCCATTTCTGCA
AGAAATGTCAGAGATATTGGACAGCTGGTGGAACGATGAGGAATGTTCCGGTTGGTGCTGGG
AGACGTAAGAATAAGAGTCCAGCTTCTCATTATAACCGTCATGTAAGTATAACATCTGCGGA
AGCTATGCAGAAGGTGGCGAGAACTGATCTTCAACATCCTAATGGTGCAAATCTTCTCACTT
TTGGCTCTGATTCTGTGCTTTGTGAATCTATGGCTTCTGGATTGAATCTTGTTGAGAAGTCA
TTGTTGAAGCACAAACTGTATTGCAAGAACCCAATGAAGGCTTGAAGATTACGGTTCCGTT
AAACCAGACAAACGAAGAAGCTGGAACAGTCAGCCCGTTACCAAAAGTTCCATGCTTTCCAG
GACCACCACCAACTTGGCCTTACGCTTGGAACGGAGTTTCGTGGACGATTTTACCGTTTTAC
CCTCCACCGGCTTACTGGAGCTGCCCGGGGGTTTCACCGGGGGCATGGAACAGCTTCACATG
GATGCCACAACCCAATTCACCATCTGGTTCCAATCCAAATTCTCCTACACTAGGTAAACATT
```

FIGURE 28 (continued)

```
CACGTGACGAGAACGCTGCTGAACCAGGAACCGCTTTTGATGAAACCGAGTCACTTGGTAGG
GAGAAAAGCAAACCCGAGAGATGCTTGTGGGTTCCCAAGACGCTGAGGATTGATGATCCAGA
GGAAGCTGCTAAAAGTTCCATCTGGGAAACATTAGGGATCAAAAAAGACGAAAATGCGGATA
CTTTCGGAGCTTTCAGATCATCAACCAAAGAAAAAGCAGTCTTTCTGAAGGAAGACTTCCG
GGAAGAAGACCGGAGTTGCAAGCGAATCCTGCTGCTCTTTCTAGGTCAGCAAACTTCCATGA
GAGCTCATAG
```

SEQ ID NO: 255, Arabidopsis thaliana – protein – At5g39660
```
MADPAIKLFGKTIPLPELGVVDSSSSYTGFLTETQIPVRLSDSCTGDDDDEEMGDSGLGREE
GDDVGDGGGESETDKKEEKDSECQEESLRNESNDVTTTTSGITEKTETTKAAKTNEESGGTA
CSQEGKLKKPDKILPCPRCNSMETKFCYYNNYNVNQPRHFCKKCQRYWTAGGTMRNVPVGAG
RRKNKSPASHYNRHVSITSAEAMQKVARTDLQHPNGANLLTFGSDSVLCESMASGLNLVEKS
LLKTQTVLQEPNEGLKITVPLNQTNEEAGTVSPLPKVPCFPGPPPTWPYAWNGVSWTILPFY
PPPAYWSCPGVSPGAWNSFTWMPQPNSPSGSNPNSPTLGKHSRDENAAEPGTAFDETESLGR
EKSKPERCLWVPKTLRIDDPEEAAKSSIWETLGIKKDENADTFGAFRSSTKEKSSLSEGRLP
GRRPELQANPAALSRSANFHESS
```

SEQ ID NO: 256, Artificial sequence – primer prm07303
```
GGGGACAAGTTTGTACAAAAAAGCAGGCTTAAACAATGATGATGGAGACTAGAGATC
```

SEQ ID NO: 257, Artificial sequence – primer prm07304
```
GGGGACCACTTTGTACAAGAAAGCTGGGTCATATGTAACTCTAAATCTGTTCA
```

SEQ ID NO: 258, Oryza sativa – DNA – prolamin promoter
```
CTTCTACATCGGCTTAGGTGTAGCAACACGACTTTATTATTATTATTATTATTATTATT
ATTTTACAAAAATATAAAATAGATCAGTCCCTCACCACAAGTAGAGCAAGTTGGTGAGTTAT
TGTAAAGTTCTACAAAGCTAATTTAAAAGTTATTGCATTAACTTATTTCATATTACAAACAA
GAGTGTCAATGGAACAATGAAAACCATATGACATACTATAATTTTGTTTTTATTATTGAAAT
TATATAATTCAAAGAGAATAAATCCACATAGCCGTAAAGTTCTACATGTGGTGCATTACCAA
AATATATATAGCTTACAAAACATGACAAGCTTAGTTTGAAAAATTGCAATCCTTATCACATT
GACACATAAAGTGAGTGATGAGTCATAATATTATTTTCTTTGCTACCCATCATGTATATATG
ATAGCCACAAAGTTACTTTGATGATGATATCAAAGAACATTTTTAGGTGCACCTAACAGAAT
ATCCAAATAATATGACTCACTTAGATCATAATAGAGCATCAAGTAAAACTAACACTCTAAAG
CAACCGATGGGAAAGCATCTATAAATAGACAAGCACAATGAAAATCCTCATCATCCTTCACC
ACAATTCAAATATTATAGTTGAAGCATAGTAGTA
```

SEQ ID NO: 259, Oryza sativa – DNA – wsi18 promoter
```
GCTTGAGTCATAGGGAGAAAACAAATCGATCATATTTGACTCTTTTCCCTCCATCTCTCTTA
CCGGCAAAAAAGTAGTACTGGTTTATATGTAAAGTAAGATTCTTTAATTATGTGAGATCCG
GCTTAATGCTTTTCTTTTGTCACATATACTGCATTGCAACAATTGCCATATATTCACTTCTG
CCATCCCATTATATAGCAACTCAAGAATGGATTGATATATCCCCTATTACTAATCTAGACAT
GTTAAGGCTGAGTTGGGCAGTCCATCTTCCCAACCCACCACCTTCGTTTTTCGCGCACATAC
TTTTCAAACTACTAAATGGTGTGTTTTTAAAAATATTTTCAATACAAAAGTTGCTTTAAAA
AATTATATTGATCCATTTTTTAAAAAAAATAGCTAATACTTAATTAATCACGTGTTAAAAG
ACCGCTCCGTTTTGCGTGCAGGAGGGATAGGTTCACATCCTGCATTACCGAACACAGCCTAA
ATCTTGTTGTCTAGATTCGTAGTACTGGATATATTAAATCATGTTCTAAGTTACTATATACT
GAGATGAATAGAATAAGTAAAATTAGACCCACCTTAAGTCTTGATGAAGTTACTACTAGCTG
```

FIGURE 28 (continued)

```
CGTTTGGGAGGACTTCCCAAAAAAAAAAGTATTAGCCATTAGCACGTGATTAATTAAGTACT
AGTTTAAAAAACTTAAAAAATAAATTAATATGATTCTCTTAAGTAACTCTCCTATAGAAAAC
TTTTACAAAATTACACCGTTTAATAGTTTGGAAAATATGTCAGTAAAAAATAAGAGAGTAGA
AGTTATGAAAGTTAGAAAAGAATTGTTTTAGTAGTATACAGTTATAAACTATTCCCTCTGT
TCTAAAACATAAGGGATTATGGATGGATTCGACATGTACCAGTACCATGAATCGAATCCAGA
CAAGTTTTTTATGCATATTTATTCTACTATAATATATCACATCTGCTCTAAATATCTTATAT
TTCGAGGTGGAGACTGTCGCTATGTTTTTCTGCCCGTTGCTAAGCACACGCCACCCCCGATG
CGGGGACGCCTCTGGCCTTCTTGCCACGATAATTGAATGGAACTTCCACATTCAGATTCGAT
AGGTGACCGTCGACTCCAAGTGCTTTGCACAAAACAACTCCGGCCTCCCGGCCACCAGTCAC
ACGACTCACGGCACTACCACCCCTGACTCCCTGAGGCGGACCTGCCACTGTTCTGCATGCGA
AGCTATCTAAAATTCTGAAGCAAAGAAAGCACAGCACATGCTCCGGGACACGCGCCACCCGG
CGGAAAAGGGCTCGGTGTGGCGATCTCACAGCCGCATATCGCATTTCACAAGCCGCCCATCT
CCACCGGCTTCACGAGGCTCATCGCGGCACGACCGCGCACGGAACGCACGCGGCCGACCCGC
GCGCCTCGATGCGCGAGCCCATCCGCCGCGTCCTCCCTTTGCCTTTGCCGCTATCCTCTCGG
TCGTATCCCGTTTCTCTGTCTTTTGCTCCCCGGCGCGCGCCAGTTCGGAGTACCAGCGAAAC
CCGGACACCTGGTACACCTCCGCCGGCCACAACGCGTGTCCCCCCTACGTGGCCGCGCAGCA
CATGCCCATGCGCGACACGTGCACCTCCTCATCCAAACTCTCAAGTCTCAACGGTCCTATAA
ATGCACGGATAGCCTCAAGCTGCTCGTCACAAGGCAAGAGGCAAGAGGCAAGAGCATCCGTA
TTAACCAGCCTTTTGAGACTTGAGAGTGTGTGTGACTCGATCCAGCGTAGTTTCAGTTCGTG
TGTTGGTGAGTGATTCCAGCCAAGTTTGCG
```

SEQ ID NO: 260, Oryza sativa - DNA - expansin promoter
```
AAAACCACCGAGGGACCTGATCTGCACCGGTTTTGATAGTTGAGGGACCCGTTGTGTCTGGT
TTTCCGATCGAGGGACGAAAATCGGATTCGGTGTAAAGTTAAGGGACCTCAGATGAACTTAT
TCCGGAGCATGATTGGGAAGGGAGGACATAAGGCCCATGTCGCATGTGTTTGGACGGTCCAG
ATCTCCAGATCACTCAGCAGGATCGGCCGCGTTCGCGTAGCACCCGCGGTTTGATTCGGCTT
CCCGCAAGGCGGCGGCCGGTGGCCGTGCCGCCGTAGCTTCCGCCGGAAGCGAGCACGCCGCC
GCCGCCGACCCGGCTCTGCGTTTGCACCGCCTTGCACGCGATACATCGGGATAGATAGCTAC
TACTCTCTCCGTTTCACAATGTAAATCATTCTACTATTTTCCACATTCATATTGATGTTAAT
GAATATAGACATATATATCTATTTAGATTCATTAACATCAATATGAATGTAGGAAATGCTAG
AATGACTTACATTGTGAATTGTGAAATGGACGAAGTACCTACGATGGATGGATGCAGGATCA
TGAAAGAATTAATGCAAGATCGTATCTGCCGCATGCAAATCTTACTAATTGCGCTGCATAT
ATGCATGACAGCCTGCATGCGGGCGTGTAAGCGTGTTCATCCATTAGGAAGTAACCTTGTCA
TTACTTATACCAGTACTACATACTATATAGTATTGATTTCATGAGCAAATCTACAAAACTGG
AAAGCAATAAGAAATACGGGACTGGAAAAGACTCAACATTAATCACCAAATATTTCGCCTTC
TCCAGCAGAATATATATCTCTCCATCTTGATCACTGTACACACTGACAGTGTACGCATAAAC
GCAGCAGCCAGCTTAACTGTCGTCTCACCGTCGCACACTGGCCTTCCATCTCAGGCTAGCTT
TCTCAGCCACCCATCGTACATGTCAACTCGGCGCGCGCACAGGCACAAATTACGTACAAAAC
GCATGACCAAATCAAAACCACCGGAGAAGAATCGCTCCCGCGCGCGGCGGCGACGCGCACGT
ACGAACGCACGCACGCACGCCCAACCCCACGACACGATCGCGCGCGACGCCGGCGACACCGG
CCGTCCACCCGCGCCCTCACCTCGCCGACTATAAATACGTAGGCATCTGCTTGATCTTGTCA
TCCATCTCACCACCAAAAAAAAAAGGAAAAAAAAACAAAACACACCAAGCCAAATAAAAGCG
ACA
```

SEQ ID NO: 261, MOTIF 1
FXXKYNFD wherein X is any amino acid

SEQ ID NO: 262, MOTIF 2
[P/L]LXGRYEW

> wherein X is any amino acid and [P/L] means that either a proline or a leucine appear at the indicated position

SEQ ID NO: 263, MOTIF 3
EXE[D/E]FFXXXE (SEQ ID NO: 3)

> wherein X is any amino acid and [D/E] means that either an aspartate or a glutamate appear at the indicated position

SEQ ID NO: 264, MOTIF 4
YXQLRSRR

> wherein X is any amino acid

SEQ ID NO: 265, MOTIF 5
MGKY[M/I][K/R]KX[K/R]

> wherein X is any amino acid, [M/I] means that either a methionine or an isoleucine appear at the indicated position, and [K/R] means that either a lysine or an arginine appear at the indicated position

SEQ ID NO: 266, MOTIF 6
SXGVRTRA

> wherein X is any amino acid

SEQ ID NO: 267, Oryza sativa CKI4 full length cDNA AK073804.1
ATGGGCAAGTACATGCGCAAGGCCAAGGTGGTGGTCTCCGGCGAGGTGGTGGCCGCCGCCGT
CATGGAGCTCGCCGCGGCGCCGCTCGGGGTGCGCACCCGCGCCCGCTCCCTCGCGCTGCAGA
AGAGGCAGGGCGGGGAGTACCTCGAGCTCAGGAGCCGCAGGCTCGAGAAGCTCCCTCCTCCC
CCGCCGCCGCCGAGGAGGAGGGCGACGGCTGCGGCTGCGACTGCTGATGCGACGGCGAC
GGAGAGCGCGGAGGCGGAGGTGTCGTTCGGGGGGGAGAACGTCCTCGAGCTGGAGGCCATGG
AAAGGAATACCAGGGAGACGACACCTTGCAGCTTGATCAGGGACCCCGATACGATTAGCACC
CCTGGATCTACCACAAGGCGCAGCCACTCGAGTTCTCATTGCAAGGTGCAAACACCCGTGCG
CCACAACATTATTCCAGCATCAGCAGAGCTGGAAGCGTTCTTCGCCGCCGAAGAGCAACGGC
AACGACAGGCTTTCATCGACAAGTATAACTTTGATCCTGTGAATGACTGCCCTCTTCCCGGC
CGATTTGAATGGGTCAAGCTAGACTGA

FIGURE 33

SEQ ID NO: 268, Oryza sativa CKI4 deduced polypeptide
MGKYMRKAKVVVSGEVVAAAVMELAAAPLGVRTRARSLALQKRQGGEYLELRSRRLEKLPPP
PPPPPRRRATAAAATADATATESAEAEVSFGGENVLELEAMERNTRETTPCSLIRDPDTIST
PGSTTRRSHSSSHCKVQTPVRHNIIPASAELEAFFAAEEQRQRQAFIDKYNFDPVNDCPLPG
RFEWVKLD

SEQ ID NO: 269, Zea mays CKI4 like full length cDNA AY986792
ATGGGCAAGTACATGCGCAAGGCCAAGGCTTCCAGCGAGGTTGTCATCATGGATGTCGCCGC
CGCTCCGCTCGGAGTCCGCACCCGAGCGCGCGCCCTCGCGCTGCAGCGTCTGCAGGAGCAAC
AGACGCAGTGGGAAGAAGGTGCTGGCGGCGAGTACCTGGAGCTAAGGAACCGGAGGCTCGAG
AAGCTGCCGCCGCCGCCGGCGACCACTAGGAGGTCGGGCGGGAGGAAAGCGGCAGCCGAGGC
CGCCGCAACTAAGGAGGCTGAGGCGTCGTACGGGGAGAACATGCTCGAGTTGGAGGCCATGG
AGAGGATTACCAGGGAGACGACGCCTTGCAGCTTGATTAACACCCAGATGACTAGCACTCCT
GGGTCCACGAGATCCAGCCACTCTTGCCACCGCAGGGTGAACGCTCCTCCGGTGCACGCCGT
CCCAAGTTCTAGGGAGATGAATGAGTACTTCGCTGCCGAACAGCGACGGCAACAGCAGGATT
TCATTGACAAGTACAACTTCGATCCTGCAAACGACTGCCCTCTCCCAGGCAGGTTTGAGTGG
GTGAAGCTAGACTGA

SEQ ID NO: 270, Zea mays CKI4 like deduced polypeptide
MGKYMRKAKASSEVVIMDVAAAPLGVRTRARALALQRLQEQQTQWEEGAGGEYLELRNRRLE
KLPPPPATTRRSGGRKAAAEAAATKEAEASYGENMLELEAMERITRETTPCSLINTQMTSTP
GSTRSGHSCHRRVNAPPVHAVPSSREMNEYFAAEQRRQQQDFIDKYNFDPANDCPLPGRFEW
VKLD

SEQ ID NO: 271, Triticum aestivum CK4 like full length cDNA contig of EST BG908519.1 and CA640135.1
ATGGGCAAGTACATGCGCAAGCCCAAGGTCTCCGGCGAGGTGGCCGTCATGGAGGTCGCCGC
CGCGCCGCTAGGGGTCCGCACCCGCGCACGAGCGCTCGCGATGCAGAGGCAGCCGCAGGGGG
CGGCGGTGGCCAAGGACCAGGGGGAGTACCTGGAGCTCAGGAGTCGGAAGCTCGAGAAGCTG
CCCCCGCCGCCGCCGGCGGCGAGGAGGAGGGCGGCCGCGGCGGAGCGTGTCGAGGCCGAGGC
CGAGGCCGACGAGGTGTCCTTCGGTGAGAACGTGCTCGAGTCGGAGGCCATGGGGAGGGGTA
CCAGGGAGACGACGCCCTGCAGCTTGATTAGGGACTCGGGAACGATAAGCACTCCTGGATCC
ACAACAAGACCGAGCCACTCGAATTCCCATCGCAGGGTGCAAGCTCCAGCGCGCCATATTAT
TCCATGTTCAGCAGAGATGAATGAGTTCTTCTCTGCTGCGGAGCAACCGCAACAGCAAGCCT
TCATTGACAAGTACAACTTTGATCCTGTGAACGACTGTCCTCTCCCAGGCCGATACGAGTGG
GTGAAGCTAGACTGATAATTCTCCAGGAAGGAGAGCACCATGTACTTCTCCGCTCCCTCCAC
CTTAGCGTCGTGGTAAAGGCCGCCCCGTCGTGTAGCTTTGTTTCCGTTGTAAAAAGAATAGT
TAGCTGTAGTAGCCTCAATGGCGTTACATACAGAGTAATGCTGATTACACCTAATCCTCAAA
CCATGTACGTT

SEQ ID NO: 272, Triticum aestivum CKI4 like deduced polypeptide
MGKYMRKPKVSGEVAVMEVAAAPLGVRTRARALAMQRQPQGAAVAKDQGEYLELRSRKLEKL
PPPPPAARRRAAAAERVEAEAEADEVSFGENVLESEAMGRGTRETTPCSLIRDSGTISTPGS
TTRPSHSNSHRRVQAPARHIIPCSAEMNEFFSAAEQPQQQAFIDKYNFDPVNDCPLPGRYEW
VKLD FIGURE 33 (continued)

SEQ ID NO: 273, Oryza sativa CKI3 full length cDNA AK064723.1
ATGGGGAAGTACATGCGGAAGGGGAAGGTGTCGGGGGAGGTGGCGGTGATGGAGGTGGGCGG
GGCGCTGCTCGGCGTCCGCACCCGCTCCCGCACGCTCGCGCTGCAGCGGACGACCTCGTCGC
AGAAGCCGCCGGAGAAGGGGGAGGGGGACCCCGGTGCGGGCGCGGGCGCGGGGGCGGAGTAC
CTCGAGCTCAGGAGCCGGAGGCTCGAGAAGCCGCCTCCGCACACGCCGCCGGCCAAGGAGAA
GGAGACCGCCAGGAGGGCTTCCGCCGCCGCCGCCGCCGTGAGGATGCCGGCGGCGCCGC
AAGCGGCCGAGGAGTTCGAGGCGGAGGTCGAGGTGTCCTTCGGCGACAACGTTCTTGACCTC
GACGGCGACGCCATGGAGAGGAGTACCAGGGAGACAACGCCTTGCAGTTTAATTAGGAGCTC
AGAAATGATAAGCACCCCTGGCTCCACAACTAAAACCAACACCTCGATCAGTTCCCGGCGCA
GAATGGAGACCTCTGTTTGTCGTTACGTTCCGAGTTCTCTTGAGATGGAAGAGTTCTTTGCA
GCTGCTGAACAACAGCAACATCAGGCTTTCAGAGAGAGGTATAACTTCTGTCCTGTGAACGA
CTGCCCACTTCCTGGACGGTACGAATGGACAAGGCTAGACTGCTAG

SEQ ID NO: 274, Oryza sativa CKI3 deduced polypeptide
MGKYMRKGKVSGEVAVMEVGGALLGVRTRSRTLALQRTTSSQKPPEKGEGDPGAGAGAGAEY
LELRSRRLEKPPPHTPPAKEKETARRASAAAAAAVRMPAAPQAAEEFEAEVEVSFGDNVLDL
DGDAMERSTRETTPCSLIRSSEMISTPGSTTKTNTSISSRRRMETSVCRYVPSSLEMEEFFA
AAEQQQHQAFRERYNFCPVNDCPLPGRYEWTRLDC

SEQ ID NO: 275, Zea mays CKI3 like full length cDNA DV174570.1
ATGGGGAAGTACATGCGCAAGGGCAAGGTGTCCGGGGAGGTCGCCGTCATGGAGGTACCCGG
CGGCGCGCTGCTCGGCGTCCGCACCCGCTCCCGCACGCTCGCGCTGCAGCGCGCGCAGAGGC
CGCTCGACAAGGGCGACGCGGAGGACGCCGCCGCGGAGTACCTCGAGCTCAGGAGCCGGAGG
CTCGAGAAGCCGCACAAGGAGCATCCGTCGCCGCCCGCGACCGCGACCAAGAGGGGCGCCGG
GAGGAAGGCCGCCGCCGCCGCCGCGGTGCAGCACGTGCTGATGCAGGACGAGGTCGAGGTCG
AGGTCTCGTTCGGGGACAACGTGCTTGACTTGGACACCATGGAAAGGAGTACCAGAGAGACA
ACACCGTGCAGCCTGATTAGGAACCCAGAGATGATAAGCACCCCAGGATCCACAACTAAAAG
CAAAACCAGCAGCAACTCGACGACTTCCCGCCGCAGAACGGAGGAAACCCCGAGCTGCCGGT
TCATACCGAGCTCGCTCGAGATGGAGGAGTTCTTCTCGGCGGCCGAGCAACAGGAGCAGCAT
AGCTTCAGGGAGAAGTACAACTTCTGTCCCGTGAACGACTGTCCTCTCCCTGGCCGGTACGA
ATGGGCGAGGCTAGACTGCTAG

SEQ ID NO: 276, Zea mays CKI3 like deduced polypeptide
MGKYMRKGKVSGEVAVMEVPGGALLGVRTRSRTLALQRAQRPLDKGDAEDAAAEYLELRSRR
LEKPHKEHPSPPATATKRGAGRKAAAAAAVQHVLMQDEVEVEVSFGDNVLDLDTMERSTRET
TPCSLIRNPEMISTPGSTTKSKTSSNSTTSRRRTEETPSCRFIPSSLEMEEFFSAAEQQEQH
SFREKYNFCPVNDCPLPGRYEWARLDC

SEQ ID NO: 277, Sorghum bicolor CKI3 like full length cDNA contig of CN152732.1 and CD224882.1
ATGGGGAAGTACATGCGCAAGGGCAAGGTGTCCGGGGAGGTCGCCGTCATGGAGGTCCCCGG
CGGCGCGCTGCTCGGCGTCCGCACCCGCTCCCGCACGCTCGCGCTGCAGCGCGCGCAGAGGC
CGCTCGACAAGGGCGACGCCGAGGACGCCGCTGCGGAGTACCTCGAGCTCAGGAGCCGGAGG
CTCGAGAAGCCGCACAAGGACCCGTTACCGCCGCCGTCTGCGCCTGCGACCAAGAGGGGCGC
CGGGAGGAAGGTCGCCACCGCCGCCGCCGCCGCGGCGCCGCACGGGCTGGCGGAGGACG
ACGTCGAGGTCTCCTTCGGCGAGAACGTGCTCGACTTCGACGCCATGGAAAGGAGTACCAGA FIGURE 33 (continued)

GAGACAACACCGTGCAGTTTGATTAGGAACCCAGAGATGATAAGCACCCCAGGATCCACAAC
TAAGAGTAAAACCAGCAACTCGATGACCTCCCGTCGCAGAATGGAAACCTCAATCTGCCGTT
TCATACCAAGTTCGCATGAGATGGAAGAGTTCTTCTCAGCAGCTGAAAAACAGGAGCAGCAA
AGCTTCAGGGAGAAGTATAACTTCTGTCCTGTGAACGACTGTCCTCTTCCGGGTCGGTATGA
ATGGGCGAGGCTAGACTGCTAG

SEQ ID NO: 278, Sorghum bicolor CKI3 like deduced polypeptide
MGKYMRKGKVSGEVAVMEVPGGALLGVRTRSRTLALQRAQRPLDKGDAEDAAAEYLELRSRR
LEKPHKDPLPPPSAPATKRGAGRKVATAAAAAAAPHGLAEDDVEVSFGENVLDFDAMERSTR
ETTPCSLIRNPEMISTPGSTTKSKTSNSMTSRRRMETSICRFIPSSHEMEEFFSAAEKQEQQ
SFREKYNFCPVNDCPLPGRYEWARLDC

SEQ ID NO: 279, Saccharum officinarum CKI4 like partial cDNA CO373621.1
GTCGACCCACGCGTCCGGTACTTCGCTGCTGAACAGCGACGCCAACAACAGGCTTTCATTGA
CAAGTACAACTTTGATCCTGTAAATGACTGCCCTCTCCCAGGCAGGTTTGAATGGGTGAAGC
TAGACTGATTGATTCAGAGGACAAGAGAGCAGCAGCATGGAACTCACCTCCGCTCCCTCCAC
CACCGCAGTGTTGTGGCAGAGGCGCATACCGTCGTGTTAGCTTTGTTTCTGTTGTAAAAACT
TAGTGTTAGCCTGTAGCCTTAATTGTCGTGTGTTACAGTACAAAACTGATGCTGAGTTACAA
CACCCTGATCTGATCTGATCCCTCAACTCAGNNGTAACCCTTAACAGCTTATTCTGTAAGGA
ACCTTACCCACCCTTGTTACCAGTT

SEQ ID NO: 280, Saccharum officinarum CKI4 like partial deduced polypeptide
YFAAEQRRQQQAFIDKYNFDPVNDCPLPGRFEWVKLD

SEQ ID NO: 281, Oryza sativa RP6 prolamin promoter
CTTCTACATCGGCTTAGGTGTAGCAACACGACTTTATTATTATTATTATTATTATTATTATT
ATTTTACAAAAATATAAAATAGATCAGTCCCTCACCACAAGTAGAGCAAGTTGGTGAGTTAT
TGTAAAGTTCTACAAAGCTAATTTAAAAGTTATTGCATTAACTTATTTCATATTACAAACAA
GAGTGTCAATGGAACAATGAAAACCATATGACATACTATAATTTTGTTTTTATTATTGAAAT
TATATAATTCAAAGAGAATAAATCCACATAGCCGTAAAGTTCTACATGTGGTGCATTACCAA
AATATATATAGCTTACAAAACATGACAAGCTTAGTTTGAAAAATTGCAATCCTTATCACATT
GACACATAAAGTGAGTGATGAGTCATAATATTATTTTCTTTGCTACCCATCATGTATATATG
ATAGCCACAAAGTTACTTTGATGATGATATCAAAGAACATTTTTAGGTGCACCTAACAGAAT
ATCCAAATAATATGACTCACTTAGATCATAATAGAGCATCAAGTAAAACTAACACTCTAAAG
CAACCGATGGGAAAGCATCTATAAATAGACAAGCACAATGAAAATCCTCATCATCCTTCACC
ACAATTCAAATATTATAGTTGAAGCATAGTAGTA

SEQ ID NO: 282, Oryza sativa Beta-expansin promoter
AAAACCACCGAGGGACCTGATCTGCACCGGTTTTGATAGTTGAGGGACCCGTTGTGTCTGGT
TTTCCGATCGAGGGACGAAAATCGGATTCGGTGTAAAGTTAAGGGACCTCAGATGAACTTAT
TCCGGAGCATGATTGGGAAGGGAGGACATAAGGCCCATGTCGCATGTGTTTGGACGGTCCAG
ATCTCCAGATCACTCAGCAGGATCGGCCGCGTTCGCGTAGCACCCGCGGTTTGATTCGGCTT
CCCGCAAGGCGGCGGCCGGTGGCCGTGCCGCCGTAGCTTCCGCCGGAAGCGAGCACGCCGCC
GCCGCCGACCCGGCTCTGCGTTTGCACCGCCTTGCACGCGATACATCGGGATAGATAGCTAC
TACTCTCTCCGTTTCACAATGTAAATCATTCTACTATTTTCCACATTCATATTGATGTTAAT FIGURE 33 (continued)

```
GAATATAGACATATATATCTATTTAGATTCATTAACATCAATATGAATGTAGGAAATGCTAG
AATGACTTACATTGTGAATTGTGAAATGGACGAAGTACCTACGATGGATGGATGCAGGATCA
TGAAAGAATTAATGCAAGATCGTATCTGCCGCATGCAAAATCTTACTAATTGCGCTGCATAT
ATGCATGACAGCCTGCATGCGGGCGTGTAAGCGTGTTCATCCATTAGGAAGTAACCTTGTCA
TTACTTATACCAGTACTACATACTATATAGTATTGATTTCATGAGCAAATCTACAAAACTGG
AAAGCAATAAGAAATACGGGACTGGAAAAGACTCAACATTAATCACCAAATATTTCGCCTTC
TCCAGCAGAATATATATCTCTCCATCTTGATCACTGTACACACTGACAGTGTACGCATAAAC
GCAGCAGCCAGCTTAACTGTCGTCTCACCGTCGCACACTGGCCTTCCATCTCAGGCTAGCTT
TCTCAGCCACCCATCGTACATGTCAACTCGGCGCGCGCACAGGCACAAATTACGTACAAAAC
GCATGACCAAATCAAAACCACCGGAGAAGAATCGCTCCCGCGCGCGGCGGCGACGCGCACGT
ACGAACGCACGCACGCACGCCCAACCCCACGACACGATCGCGCGCGACGCCGGCGACACCGG
CCGTCCACCCGCGCCCTCACCTCGCCGACTATAAATACGTAGGCATCTGCTTGATCTTGTCA
TCCATCTCACCACCAAAAAAAAAGGAAAAAAAAACAAAACACACCAAGCCAAATAAAAGCG
ACA
```

SEQ ID NO: 283, Nicotiana tabacum Rb7 matrix attachment region/scaffold attachment region sequence
```
CTGCCATTCTTTAGAGGGGATGCTTGTTTAAGAACAAAAAATATATCACTTTCTTTTGTTCC
AAGTCATTGCGTATTTTTTTAAAAATATTTGTTCCTTCGTATATTTCGAGCTTCAATCACTT
TATGGTTCTTTGTATTCTGGCTTTGCTGTAAATCGTAGCTAACCTTCTTCCTAGCAGAAATT
ATTAATACTTGGGATATTTTTTAGAATCAAGTAAATTACATATTACCACCACATCGAGCTG
CTTTTAAATTCATATTACAGCCATATAGGCTTGATTCATTTTGCAAAATTTCCAGGATATTG
ACAAC
```

SEQ ID NO: 284, prm00472 forward primer
```
GGGGACAAGTTTGTACAAAAAAGCAGGCTTCACAATGGGCAAGTACATGCGCA
```

SEQ ID NO: 285, prm00473 reverse primer
```
GGGGACCACTTTGTACAAGAAAGCTGGGTGGAGCAGAGAGGTCCATGGTGCCC
```

PLANTS HAVING IMPROVED GROWTH CHARACTERISTICS AND METHODS FOR MAKING THE SAME

RELATED APPLICATIONS

This application is a national stage application (under 35 U.S.C. 371) of PCT/US2006/045721 filed Nov. 29, 2006, which claims benefit of European application EP 05111597.0 filed Dec. 1, 2005, European application EP 05111691.1 filed Dec. 5, 2005, U.S. Provisional application U.S. 60/742,352 filed Dec. 5, 2005, European application EP 05111786.9 filed Dec. 7, 2005, U.S. Provisional application U.S. 60/748,903 filed Dec. 8, 2005, U.S. Provisional application U.S. 60/749,219 filed Dec. 9, 2005, European application EP 05111996.4 filed Dec. 12, 2005, U.S. Provisional application U.S. 60/750,143 filed Dec. 14, 2005, European application EP 05112562.3 filed Dec. 21, 2005, U.S. Provisional application U.S. 60/753,650 filed Dec. 23, 2005, European application EP 05113110.0 filed Dec. 30, 2005, European application EP 05113111.8 filed Dec. 30, 2005, U.S. Provisional application U.S. 60/756,086 filed Jan. 4, 2006, and U.S. Provisional application U.S. 60/756,042 filed Jan. 4, 2006.

SEQUENCE LISTING SUBMISSION

The Sequence Listing associated with this application is filed in electronic format via EFS-Web and hereby incorporated by reference into the specification in its entirety. The name of the text file containing the Sequence Listing is Revised_Sequence_Listing_14546_00031_US. The size of the text file is 614 KB, and the text file was created on Jun. 3, 2011.

The present invention relates generally to the field of molecular biology and concerns a method for improving various plant growth characteristics by modulating expression in a plant of a nucleic acid encoding a GRP (Growth-Related Protein). The present invention also concerns plants having modulated expression of a nucleic acid encoding a GRP, which plants have improved growth characteristics relative to corresponding wild type plants or other control plants. The invention also provides constructs useful in the methods of the invention.

Given the ever-increasing world population, and the dwindling area of land available for agriculture, it remains a major goal of research to improve the efficiency of agriculture and to increase the diversity of plants in horticulture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic complements that may not always result in the desirable trait being passed on from parent plants. Advances in molecular biology have allowed mankind to manipulate the germplasm of animals and plants. Genetic engineering of plants entails the isolation and manipulation of genetic material (typically in the form of DNA or RNA) and the subsequent introduction of that genetic material into a plant. Such technology has led to the development of plants having various improved economic, agronomic or horticultural traits. Traits of particular economic interest are growth characteristics such as high yield. Yield is normally defined as the measurable produce of economic value from a crop. This may be defined in terms of quantity and/or quality. Yield is directly dependent on several factors, for example, the number and size of the organs, plant architecture (for example, the number of branches), seed production and more. Root development, nutrient uptake and stress tolerance may also be important factors in determining yield.

Seed yield is a particularly important trait, since the seeds of many plants are important for human and animal nutrition. Crops such as, corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. Early vigour may also result from increased plant fitness due to, for example, the plants being better adapted to their environment (i.e. being more able to cope with various abiotic or biotic stress factors). Plants having early vigour also show better establishment of the crop (with the crop growing in a more uniform manner, i.e. with the majority of plants reaching the various stages of development at substantially the same time), and show better growth and often better yield.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the leafy parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing (seed) yield in plants may be through modification of the inherent growth mechanisms of a plant. One such mechanism is the cell cycle.

It has now been found that various growth characteristics may be improved in plants by modulating expression in a plant of a nucleic acid encoding a GRP (Growth-Related Protein) in a plant. The GRP may be one of the following: Seed Yield Regulator (SYR), FG-GAP, CYP90B, CDC27, AT-hook transcription factors, DOF transcription factors and Cyclin Dependent Kinase Inhibitors (CKIs).

BACKGROUND

Seed Yield Regulator (SYR)

There is a continuous need to find new seed yield enhancement genes and several approaches have been used so far, for example through manipulation of plant hormone levels (WO 03/050287), through manipulation of the cell cycle (WO 2005/061702), through manipulation of genes involved in salt stress response (WO 2004/058980) amongst other strategies.

SYR is a new protein that has hitherto not been characterised. SYR shows some homology (around 48% sequence identity on the DNA level, around 45% on the protein level) to an *Arabidopsis* protein named ARGOS (Hu et al., Plant Cell 15, 1951-1961, 2003; US 2005/0108793). Hu et al. postulated that ARGOS is a protein of unique function and is encoded by a single gene. The major phenotypes of ARGOS overexpression in *Arabidopsis* are increased leafy biomass and delayed flowering.

FG-GAP

FG-GAP proteins are putative transmembrane proteins. They are characterised by the presence of one or more FG-GAP domains (Pfam accession number PF01839) and by the presence of an N-terminal signal peptide and a transmembrane domain in the C-terminal half of the protein.

One such protein, DEX1, was isolated from *Arabidopsis* and was reported to play a role during pollen development (Paxson-Sowders et al. Plant Physiol. 127, 1739-1749, 2001). Dex1 mutant plants were shown to be defective in pollen wall pattern formation. The DEX1 gene encodes an 896-amino acid protein that is predicted to localize to the plasma membrane, with residues 1 through to 860 being located outside of the cell, residues 880 through to 895 on the cytoplasmic side of the membrane, and amino acids 861 through to 879 representing a potential membrane-spanning domain. Twelve potential N-glycosylation sites are present in DEX1. Therefore, the protein has the potential to be heavily modified and interact with various components of the cell wall. DEX1 shows the greatest sequence similarity to a hemolysin-like protein from *V. cholerae*, whereas an approximately 200-amino acid segment of DEX1 (amino acids 439643) also shows limited similarity to the calcium-binding domain of alpha-integrins. In this region are at least two sets of putative calcium-binding ligands that are also present in a predicted *Arabidopsis* calmodulin protein (AC009853). Therefore, it appears that DEX1 may be a calcium-binding protein. DEX1 appears to be a unique plant protein; homologs are not present in bacteria, fungi, or animals.

The alterations observed in dex1 plants, as well as the predicted structure of DEX1, raise several possibilities for the role of the protein in pollen wall formation (Paxson-Sowders et al., 2001):

(a) DEX1 could be a linker protein. It may associate with the microspore membrane and participate in attaching either the primexine or sporopollenin to the plasma membrane. Absence of the protein from the microspore surface could result in structural alterations in the primexine. The numerous potential N-glycosylation sites are consistent with attachment of DEX1 to the callose wall, the intine, or both.

(b) DEX1 may be a component of the primexine matrix and play a role in the initial polymerization of the primexine. Changes in Ca+2 ion concentrations appear to be important for pollen wall synthesis; beta-glucan synthase is activated by micromolar concentrations of Ca+2 during callose wall formation.

(c) DEX1 could be part of the rough ER and be involved in processing and/or transport of primexine precursors to the membrane. The delayed appearance and general alterations in the primexine are consistent with a general absence of primexine precursors. The primexine matrix is initially composed of polysaccharides, proteins, and cellulose, followed by the incorporation of more resistant materials. Therefore, DEX1 may participate in the formation or transport of any number of different components.

CYP90B

Brassinosteroids (BRs) are a class of plant hormones that are important for promoting plant growth, division and development. The term BR collectively refers to more than forty naturally occurring poly-hydroxylated sterol derivatives, with structural similarity to animal steroid hormones. Among these, brassinolide has been shown to be the most biologically active (for review, Clouse (2002) Brassinosteroids. The *Arabidopsis* Book: 1-23).

The BR biosynthetic pathway has been elucidated using biochemical and mutational analyses. BRs are synthesized via at least two branched biochemical pathways starting from the same initial precursor, campesterol (Fujioka et al. (1997) Physiol Plant 100:710-715). The discovered BR biosynthesis genes have been found to encode mostly cytochrome P450 monooxygenases (CYP) (Bishop and Yokota (2001) Plant Cell Physiol 42:114-120). CYP superfamily of enzymes catalyses the oxidation of many chemicals, and in the present case more specifically catalyse essential oxidative reactions in the biosynthesis of BRs. One of the important steps identified consists in the hydroxylation of the steroid side chain of BR intermediates campestanol and 6-oxocampestanol to form 6-deoxocathasterone and cathasterone respectively. These two parallel oxidative steps are also collectively called the early steroid C-22 alpha-hydroxylation step (Choe et al. (1998) Plant Cell 10: 231-243). In *Arabidopsis*, a specific CYP enzyme, CYP90B1 or DWF4, performs this step (for general reference on plant CYP nomenclature, Nelson et al. (2004) Plant Phys 135: 756-772).

*Arabidopsis* mutant plants lacking steroid 22 alpha hydroxylase activity due insertion of a T-DNA in the DWF4 locus displayed a dwarfed phenotype due to lack of cell elongation (Choe et al. (1998) Plant Cell 10: 231-243). Biochemical feeding studies with BR biosynthesis intermediates showed that all of the downstream compounds rescued the phenotype, whereas the known precursors failed to do so.

Transgenic *Arabidopsis* and tobacco plants, both dicotyledonous, were generated that ectopically overexpressed an *Arabidopsis* DWF4 genomic fragment, using the cauliflower mosaic virus 35S promoter (Choe et al. (2001) Plant J 26(6): 573-582). Phenotypic characterisation of the plants showed that the hypocotyl length, plant height at maturity, total number of branches and total number of seeds were increased in the transgenics compared to control plants. Choe et al. found that the increased seed production was due to a greater number of seeds per plant, seed size increase being within the range of standard deviation. These experiments are further described in WO00/47715.

U.S. Pat. No. 6,545,200 relates to isolated nucleic acid fragments encoding sterol biosynthetic genes, and more specifically claims a nucleotide sequence encoding a polypeptide having C-8,7 sterol isomerase activity. Partial nucleotides sequences encoding DWF4 are disclosed.

US 2004/0060079 relates to a method of producing a modified monocotyledonous plant having a desired trait. An example is provided in which the rice DWF4-encoding nucleotide sequence (referred to either OsDWF4 or CYP90B2) is placed under the control of a constitutive promoter, the rice actin promoter. Fourteen of the thirty-six transgenic rice plants expressing the chimeric construct show an increased number of grains per spike as compared to non-transformed control plants. According to the inventors, the yield increase in the transgenics compared to the wild types is due to an increase in total number of seeds, as no significant difference is found in the "weight of 10 grains". CDC27

Depending on the end use, the modification of certain yield traits may be favoured over others. For example for applications such as forage or wood production, or bio-fuel resource, an increase in the leafy parts of a plant may be desirable, and for applications such as flour, starch or oil production, an increase in seed parameters may be particularly desirable. Even within the seed parameters, some may be favoured over others, depending on the application. Various mechanisms may contribute to increasing seed yield, whether that is in the form of increased seed size or increased seed number. One such mechanism is the cell cycle.

Progression through the cell cycle is fundamental to the growth and development of all multicellular organisms and is crucial to cell proliferation. The major components of the cell cycle are highly conserved in yeast, mammals, and plants. The cell cycle is typically divided into the following sequential phases: G0-G1-S-G2-M. DNA replication or synthesis generally takes place during the 8 phase ("S" is for DNA synthesis) and mitotic segregation of the chromosomes occurs during the M phase (the "M" is for mitosis), with intervening gap phases, G1 (during which cells grow before DNA replication) and G2 (a period after DNA replication during which the cell prepares for division). Cell division is completed after cytokinesis, the last step of the M phase. Cells that have exited the cell cycle and that have become quiescent are said to be in the G0 phase. Cells in this phase can be stimulated to renter the cell cycle at the G1 phase. The "G" in G1, G2 and G0 stands for "gap" Completion of the cell cycle process allows each daughter cell during cell division to receive a full copy of the parental genome.

Cell division is controlled by two principal cell cycle events, namely initiation of DNA synthesis and initiation of mitosis. Each transition to each of these key events is controlled by a checkpoint represented by specific protein complexes (involved in DNA replication and division). The expression of genes necessary for DNA synthesis at the G1/S boundary is regulated by the E2F family of transcription factors in mammals and plant cells (La Thangue, 1994; Muller et al., 2001; De Veylder et al., 2002). Entry into the cell cycle is regulated/triggered by an E2F/Rb complex that integrates signals and allows activation of transcription of cell cycle genes. The transition between the different phases of the cell cycle, and therefore progression through the cell cycle, is driven by the formation and activation of different heterodimeric serine/threonine protein kinases, generally referred to as cyclin-dependent kinases (CDKs). A prerequisite for activity of these kinases is the physical association with a specific cyclin, the timing of activation being largely dependent upon cyclin expression. Cyclin-binding induces conformational changes in the N-terminal lobe of the associating CDK and contributes to the localisation and substrate specificity of the complex. Monomeric CDKs are activated when they are associated with cyclins and thus have a kinase activity. Cyclin protein levels fluctuate in the cell cycle and therefore represent a major factor in determining timing of CDK activation. The periodic activation of these complexes containing cyclins and CDK during cell cycle mediates the temporal regulation of cell cycle transitions (checkpoints).

Mechanisms exist to ensure that DNA replication occurs only once during the cell cycle. For example, CDC16, CDC23 and CDC27 proteins are part of a high molecular weight complex known as the anaphase promoting complex (APC) or cyclosome, (see Romanowski and Madine, Trends in Cell Biology 6, 184-188, 1996, and Wuarin and Nurse, Cell 85, 785787 (1996). The complex in yeast is composed of at least eight proteins, the TPR-(tetratrico peptide repeat) containing proteins CDC16, CDC23 and CDC27, and five other subunits named APC1, APC2, APC4, APC5 and APC7 (Peters et al. 1996, Science 274, 1199-1201). The APC targets its substrates for proteolytic degradation by catalyzing the ligation of ubiquitin molecules to these substrates. APC-dependent proteolysis is required for the separation of the sister chromatids at meta- to anaphase transition and for the final exit from mitosis. Among the APC-substrates are the anaphase inhibitor protein Pds1p and mitotic cyclins such as cyclin B, respectively (Ciosk et al. 1998, Cell 93, 1067-1076; Cohen-Fix et al. 1996, Genes Dev 10, 3081-3093; Sudakin et al. 1995, Mol Biol Cell 6, 185-198; Jorgensen et al. 1998, Mol Cell Biol 18, 468-476; Townsley and Ruderman 1998, Trends Cell Biol 8, 238-244). To become active as an ubiquitin-ligase, at least CDC16, CDC23 and CDC27 need to be phosphorylated in the M-phase (Ollendorf and Donoghue 1997, J Biol Chem 272, 32011-32018). Activated APC persists throughout G1 of the subsequent cell cycle to prevent premature appearance of B-type cyclins, which would result in an uncontrolled entry into the S-phase (Imiger and Nasmyth 1997, J Cell Sci 110, 1523-1531). It has been demonstrated in yeast that mutations in either of at least two of the APC components, CDC16 and CDC27, can result in DNA over-replication without intervening passages through M-phases (Heichman and Roberts 1996, Cell 85, 39-48). This process of replication of nuclear DNA without subsequent mitosis and cell division is called DNA endoreduplication, and leads to increased cell size.

CDC16, CDC23 and CDC27 all are tetratrico peptide repeat (TPR; 34 amino acids long) containing proteins. A suggested minimal consensus sequence of the TPR motif is as follows: $X_3$-W-$X_2$-L-G-$X_2$-Y-$X_8$-A-$X_3$-F-$X_2$-A-$X_4$-P-$X_2$, (SEQ ID NO: 286) where X is any amino acid (Lamb et al. 1994, EMBO J. 13, 4321-4328). The consensus residues can exhibit significant degeneracy and little or no homology is present in non-consensus residues. It is the hydrophobicity and size of the consensus residues, rather than their identity, that seems to be of importance. TPR motifs are present in a wide variety of proteins functional in yeast and higher eukaryotes in mitosis (including the APC protein components CDC16, CDC23 and CDC27), transcription, splicing, protein import and neurogenesis (Goebl and Yanagida 1991, Trends Biochem Sci 16, 173-177). The TPR forms an α-helical structure; tandem repeats organize into a superhelical structure ideally suited as interfaces for protein recognition (Groves and Barford 1999, Curr Opin Struct Biol 9, 383-389). Within the α-helix, two amphipathic domains are usually present, one at the $NH_2$ terminal region and the other near the COOH terminal region (Sikorski et al. 1990, Cell 60, 307-317).

CDC27 (also known as Hobbit; others names include CDC27, BimA, Nuc2 or makos) has been isolated from various organisms, including *Aspergillus nidulans*, yeast, *drosophila*, human and various plants (such as *Arabidopsis thaliana* and *Otyza sativa*). The gene encoding CDC27 is present as a single copy in most genomes, but two copies may exceptionally be found within the same genome, for example in *Arabidopsis thaliana*. The two genes encoding CDC27 proteins have been named CDC27A and CDC27B (MIPS references At3g16320 and At2g20000 respectively).

Published International Patent Application, WO01/02430 describes CDC27A (CDC27A1 and CDC27A2) and CDC27B sequences. Also described in this document is a truncated CDC27B amino add sequence in which 161 amino acids are missing from the NH$_2$ terminal region. Reference is made in this document to GenBank accession number AC006081 for the CDC27B gene encoding a CDC27B polypeptide truncated at the NH$_2$ terminal region. The document reports the NH$_2$ terminal region to be conserved in CDC27 homologues of different origin. The CDC27 sequences mentioned in WO01/02430 are described to be useful in modifying endoreduplication.

DNA endoreduplication occurs naturally in flowering plants, for example during seed development. DNA endoreduplication leads to enlarged nuclei with elevated DNA content It has been suggested that the increased DNA content during endoreduplication may provide for increased gene expression during endosperm development and kernel filling, since it coincides with increased enzyme activity and protein accumulation at this time (Kowles et al., (1992) Genet. Eng. 14:65-88). In cereal species, the cellular endosperm stores the reserves of the seed during a phase marked by endoreduplication. The magnitude of DNA endoreduplication is highly correlated with endosperm fresh weight, which implies an important role of DNA endoreduplication in the determination of endosperm mass (Engelen-Eigles et al. (2000) Plant Cell Environ. 23:657-663). In maize for example, the endosperm makes up 70 to 90% of kernel mass; thus, factors that mediate endosperm development to a great extent also determine grain yield of maize, via individual seed weight. Increased endoreduplication is therefore typically indicative of increased seed biomass but is in no way related to increased seed number.

AT-Hook Transcription Factor

An AT-hook domain is found in polypeptides belonging to a family of transcription factors associated with Chromatin remodeling. The AT-hook motif is made up of 13 or so (sometimes about 9) amino acids which participate in DNA binding and which have a preference for A/T rich regions. In *Arabidopsis* there are at least 34 proteins containing AT-hook domains. These proteins share homology along most of the sequence, with the AT-hook domain being a particularly highly conserved region.

International Patent application WO 2005/030966 describes several plant transcription factors comprising AT-hook domains and the use of these transcription factors to produce plants having increased biomass and increased stress tolerance. The application concerns members of the G1073 lade of transcription factors and states that, "Use of tissue-specific or inducible promoters mitigates undesirable morphological effects that may be associated with constitutive overexpression of G1073 clade members (e.g., when increased size is undesirable)." The data provided in this application relate to dicotyledonous plants.

In contrast to these teachings, it has now been found that expression in a monocotyledonous (monocot) plant of a polynucleic acid encoding an AT-hook transcription factor comprising a DUF296 domain (which includes members of lade G1073), gives plants having little or no increase in biomass compared with suitable control plants, regardless of whether that expression is driven by a constitutive promoter or in a tissue-specific manner. This suggests that teachings concerning expression of such transcription factors in dicots may not be so readily applicable to monocots. It has also now been found that the extent or nature of any increase in seed yield obtained is dependent upon the tissue-specific promoter used.

DOF Transcription Factors

Dof domain proteins are plant-specific transcription factors with a highly conserved DNA-binding domain with a single C$_2$-C$_2$ zinc finger. During the past decade, numerous Dof domain proteins have been identified in both monocots and dicots including maize, barley, wheat, rice, tobacco, *Arabidopsis*, pumpkin, potato and pea. Dof domain proteins have been shown to function as transcriptional activators or repressors in diverse plant-specific biological processes.

Cyclin Dependent Kinase Inhibitors (CKI)

The ability to increase plant seed yield, whether through seed number, seed biomass, seed development, seed filling or any other seed-related trait would have many applications in agriculture, and even many non-agricultural uses such as in the biotechnological production of substances such as pharmaceuticals, antibodies or vaccines. One approach to increasing seed yield in plants may be through modification of the inherent growth mechanisms of a plant.

The inherent growth mechanisms of a plant reside in a highly ordered sequence of events collectively known as the 'cell cycle'. Progression through the cell cycle is fundamental to the growth and development of all multi-cellular organisms and is crucial to cell proliferation. The major components of the cell cycle are highly conserved in yeast, mammals, and plants. The cell cycle is typically divided into the following sequential phases: G0-G1-S-G2-M. DNA replication or synthesis generally takes place during the S phase ("S" is for DNA synthesis) and mitotic segregation of the chromosomes occurs during the M phase (the "M" is for mitosis), with intervening gap phases, G1 (during which cells grow before DNA replication) and G2 (a period after DNA replication during which the cell prepares for division). Cell division is completed after cytokinesis, the last step of the M phase. Cells that have exited the cell cycle and that have become quiescent are said to be in the G0 phase. Cells in this phase can be stimulated to renter the cell cycle at the G1 phase. The "G" in G1, G2 and G0 stands for "gap". Completion of the cell cycle process allows each daughter cell during cell division to receive a full copy of the parental genome.

Cell division is controlled by two principal cell cycle events, namely initiation of DNA synthesis and initiation of mitosis. Each transition to each of these key events is controlled by a checkpoint represented by specific protein complexes (involved in DNA replication and division). The expression of genes necessary for DNA synthesis at the G1/S boundary is regulated by the E2F family of transcription factors in mammals and plant cells (La Thangue, 1994; Muller et al., 2001; De Veylder et al., 2002). Entry into the cell cycle is regulated/triggered by an E2F/Rb complex that integrates signals and allows activation of transcription of cell cycle genes. The transition between the different phases of the cell cycle, and therefore progression through the cell cycle, is driven by the formation and activation of different heterodimeric serine/threonine protein kinases, generally referred to as cyclin-dependent kinases (CDKs). A prerequisite for activity of these kinases is the physical association with a specific cyclin, the timing of activation being largely dependent upon cyclin expression. Cyclin binding induces conformational changes in the N-terminal lobe of the associating CDK and contributes to the localisation and substrate specificity of the complex. Monomeric CDKs are activated when they are associated with cyclins and thus have kinase activity. Cyclin protein levels usually fluctuate in the cell cycle and therefore represent a major factor in determining timing of CDK activation. The periodic activation of these complexes containing cyclins and CDK during cell cycle mediates the temporal regulation of cell-cycle transitions (checkpoints). Other factors regulating CDK activity include cyclin dependent kinase inhibitors (CKIs or ICKs, KIPs, CIPs, INKs), CDK activating kinases (CAKs), a CDK phosphatase (Cdc25) and a CDK subunit (CKS) (Mironov et al. 1999; Reed 1996).

The existence of an inhibitor of mitotic CDKs was inferred from experiments with endosperm of maize seed (Grafi and Larkins (1995) Science 269, 1262-1264). Since then, several CKIs have been identified in various plant species, such as *Arabidopsis* (Wang et al. (1997) Nature 386(6624): 451-2; De Veylder et al. (2001) Plant Cell 13: 1653-1668; Lui et al. (2000) Plant J 21: 379-385), tobacco (Jasinski et al. (2002) Plant Physiol 2002 130(4): 871-82), *Chenopodium rubrum* (Fountain et al. (1999) Plant Phys 120: 339) or corn (Coelho et al. (2005) Plant Physiol 138: 2323-2336). The encoded proteins are characterized by a stretch of approximately 45 carboxy-terminal amino acids showing homology to the amino-terminal cyclin/Cdk binding domain of animal CKIs of the $p21^{Clp1}/p27^{Klp2}/p57^{Klp2}$-types. Outside this carboxy-terminal region, plant CKIs show little homology.

Published International patent application WO 2005/007829 in the name of Monsanto Technology LLC describes various isolated nucleic acid molecules encoding polypeptides having cyclin dependent kinase inhibitor activity.

Published International patent applications, WO 02/28893 and WO 99/14331, both in the name of CropDesign N.V., describe various plant cyclin dependent kinase inhibitors. The use of these inhibitors to increase yield is mentioned in these applications.

SUMMARY OF THE INVENTION

It has now surprisingly been found that increasing activity of a SYR protein and/or expression of a nucleic acid encoding a SYR protein in plants results in plants having increased seed yield and or increased growth rate, relative to corresponding wild type plants. It has also now surprisingly been found that overexpression of SYR in rice primarily increases seed yield, whereas the leafy biomass and flowering time are not obviously affected (in contrast to the major phenotypes of ARGOS overexpression in *Arabidopsis*, which were shown to be increased leafy biomass and delayed flowering (Hu et al., Plant Cell 15, 1951-1961, 2003; US 2005/0108793)).

According to one embodiment of the present invention there is provided a method for increasing seed yield and/or growth rate of a plant comprising increasing activity of a SYR polypeptide or a homologue thereof in a plant and/or expression of a nucleic acid encoding such a protein; and optionally selecting for plants having improved growth characteristics.

Advantageously, performance of the methods of the invention insofar as they concern SYR, result in plants having a variety of improved growth characteristics, such as improved seed yield without effect on the biomass of vegetative plant parts, when compared to corresponding control plants, and a life cycle comparable to corresponding control plants, without delay in flowering time. Further advantageously, performance of the methods according to the present invention result in plants having improved tolerance to abiotic stress relative to corresponding wild type (or other control) plants.

It has now surprisingly been found that modulating activity of an FG-GAP protein and/or expression of a nucleic acid encoding an FG-GAP protein in plants results in plants having improved growth characteristics, and in particular increased yield, relative to corresponding wild type plants.

According to another embodiment of the present invention there is provided a method for improving growth characteristics of a plant comprising modulating activity of an FG-GAP polypeptide or a homologue thereof and/or modulating expression of a nucleic acid encoding an FG-GAP polypeptide or a homologue thereof in a plant and optionally selecting for plants having improved growth characteristics.

Advantageously, performance of the methods according to the present invention, insofar as they concern an FG-GAP polypeptide or a homologue thereof, result in plants having a variety of improved growth characteristics, such as improved growth, improved yield, improved biomass, improved architecture or improved cell division, each relative to corresponding wild type plants. Preferably, the improved growth characteristics comprise at least increased yield relative to corresponding wild type plants.

It has now surprisingly been found that increasing non-constitutive expression in a plant of a nucleic acid encoding a CYP90B polypeptide or a homologue thereof gives plants having increased yield relative to suitable control plants.

According to a further embodiment of the present invention, there is provided a method for increasing plant yield comprising increasing non-constitutive expression in a plant of a nucleic acid encoding a CYP90B polypeptide or a homologue thereof.

It has now been found that preferentially increasing expression in the shoot apical meristem tissue of plants of a nucleic acid encoding a CDC27 polypeptide having at least one inactive TPR domain in the $NH_2$ terminal region of the polypeptide gives plants having increased seed number relative to suitable control plants.

The invention therefore provides a method for increasing the seed number of plants relative to that of suitable control plants, comprising preferentially increasing expression in plant shoot apical meristem tissue of a nucleic acid encoding a CDC27 polypeptide having at least one inactive TPR domain in the $NH_2$ terminal region of the polypeptide.

It has now been found that preferentially increasing expression of a nucleic acid encoding a polypeptide comprising an AT-hook domain and a DUF296 domain in endosperm tissue of a monocotyledonous plant gives plants having increased seed yield relative to suitable control plants.

A further embodiment of the present invention therefore provides a method for increasing seed yield in monocotyledonous plants relative to suitable control plants, comprising preferentially increasing expression in endosperm tissue of a monocotyledonous plant of a nucleic acid encoding a polypeptide comprising an AT-hook domain and a DUF296 domain.

It has now been found that increasing expression in a plant of a nucleic acid encoding a DOF transcription factor polypeptide gives plants having increased yield relative to suitable control plants.

According to a further embodiment of the present invention, there is provided a method for increasing plant yield comprising increasing expression in a plant of a nucleic acid encoding a DOF transcription factor polypeptide.

It has now been found that preferential reduction in expression of an endogenous CKI gene in endosperm tissue of a plant gives plants with better seed yield than seed yield in plants where there is no preferential reduction in expression of an endogenous CKI gene in plant endosperm tissue. The present invention therefore provides a method for increasing seed yield in plants relative to suitable control plants, comprising preferentially reducing expression of an endogenous CKI gene in endosperm tissue of a plant.

DETAILED DESCRIPTION OF THE INVENTION

The term "increased yield" as defined herein is taken to mean an increase in biomass (weight) of one or more parts of a plant (particularly harvestable parts) relative to corresponding wild type or other control plants, which increase in biomass may be aboveground or underground. An increase in biomass underground may be due to an increase in the biomass of plant parts, such as tubers, rhizomes, bulbs etc. Particularly preferred is an increase in any one or more of the following: increased root biomass, increased root volume, increased root number, increased root diameter and increased root length. The term increased yield also encompasses an increase in seed yield.

The term "increased seed yield" as defined herein is taken to mean an increase in any one or more of the following, each relative to corresponding wild type plants: (i) increased total seed yield, which includes an increase in seed biomass (seed weight) and which may be an increase in the seed weight per plant or on an individual seed basis; (ii) increased number of flowers ("florets") per panicle (iii) increased number of filled seeds; (iv) increased seed size; (v) increased seed volume; (vi) increased individual seed area; (vii) increased individual seed length and/or width; (viii) increased harvest index, which is expressed as a ratio of the yield of harvestable parts, such as seeds, over the total biomass; (ix) increased fill rate, (which is the number of filled seeds divided by the total number of seeds and multiplied by 100); and (x) increased thousand kernel weight (TKW), which is extrapolated from the number of filled seeds counted and their total weight. An increased TKW may result from an increased seed size and/or seed weight. An increased TKW may result from an increase in embryo size and/or endosperm size.

Taking corn as an example, a yield increase may be manifested as one or more of the following: an increase in the number of ears per plant, an increase in the number of rows, number of kernels per row, kernel weight, TKW, ear length/diameter, among others. Taking rice as an example, a yield increase may be manifested by an increase in one or more of the following: number of panicles per plant, number of spikelets per panicle, number of flowers per panicle, increase in the seed filling rate, increase in TKW, among others. An increase in yield may also result in modified architecture, or may occur as a result of modified architecture.

The improved growth characteristics obtained by performing the methods of the invention, insofar as they concern use of CDC27, result in plants having increased seed number. An increased seed number encompasses an increase in the total number of seeds and/or the number of filled seeds and/or an increase in the seed filling rate (which is the number of filled seeds divided by the total number of seeds and multiplied by 100), each relative to suitable control plants, which increase may be per plant and/or per hectare or acre. Taking corn as an example, an increase in the number of seeds is typically manifested by an increase in the number of ears per plant, an increase in the number of rows, number of kernels per row, increase in the seed filling rate, among others. Taking rice as an example, an increase in the number of seeds is typically manifested by an increase in number of panicles per plant, number of spikelets per panicle, number of flowers (florets) per panicle (which is expressed as a ratio of the number of filled seeds over the number of primary panicles), increase in the seed filling rate.

The invention therefore provides a method for increasing the seed number of plants relative to that of suitable control plants, comprising preferentially increasing expression in plant shoot apical meristem tissue of a nucleic acid encoding a CDC27 polypeptide having at least one inactive TPR domain in the $NH_2$ terminal region of the polypeptide.

Insofar as the methods of the invention concern SYR, preferably performance of the methods result in plants having increased seed yield. Further preferably, the increased seed yield comprises an increase in one or more of number of (filled) seeds, total seed weight, seed size, thousand kernel weight, fill rate and harvest index, each relative to control plants. Therefore, according to the present invention, there is provided a method for increasing plant seed yield, which method comprises increasing activity of a SYR polypeptide and/or expression in a plant of a nucleic acid encoding a SYR polypeptide or a homologue thereof.

Insofar as the methods of the invention concern FG-GAP, preferably performance of the methods result in plants having increased yield and, more particularly, increased biomass and/or increased seed yield. Preferably, the increased seed yield comprises an increase in one or more of number of (filled) seeds, total seed weight, seed size, thousand kernel weight and harvest index, each relative to control plants. Therefore, according to the present invention, there is provided a method for increasing plant yield, particularly, increased biomass and/or increased seed yield, which method comprises modulating activity of an FG-GAP polypeptide and/or expression in a plant of a nucleic acid encoding an FG-GAP polypeptide or a homologue thereof.

Insofar as the methods of the invention concern CYP90B, preferably the increased yield includes one or more of the following: increased HI, increased TKW, increased seed area and increased seed length, each relative to suitable control plants. Therefore, according to the present invention, there is provided a method for increasing plant yield, particularly seed yield, relative to suitable control plants, which method comprises increasing non-constitutive expression in a plant of a nucleic acid encoding a CYP90B polypeptide or a homologue thereof.

Insofar as methods of the invention concern AT-hook transcription factors, seed yield in monocotyledonous plants is increased. There is therefore provided a method for increasing seed yield in monocotyledonous plants relative to suitable control plants, comprising preferentially increasing expression in endosperm tissue of a monocotyledonous plant of a nucleic acid encoding a polypeptide comprising an AT-hook domain and a DUF296 domain.

Insofar as the methods of the invention concern DOF transcription factors, preferably the increased yield is increased seed yield. According to a preferred feature of the present invention, there is provided a method for increasing plant seed yield relative to seed yield of suitable control plants, which method comprises increasing expression in a plant of a nucleic acid encoding a DOF transcription factor polypeptide.

Insofar as the methods of the invention concern CKIs, the improved growth characteristic is increased seed yield. The present invention therefore provides a method for increasing seed yield in plants relative to suitable control plants, comprising preferentially reducing expression of an endogenous CKI gene in endosperm tissue of a plant.

Since the improved plants according to the present invention have increased yield (seed yield), it is likely that these plants exhibit an increased growth rate (during at least part of their life cycle), relative to the growth rate of corresponding wild type plants at a corresponding stage in their life cycle. The increased growth rate may be specific to one or more parts or cell types of a plant (including seeds), or may be throughout substantially the whole plant. Plants having an increased growth rate may have a shorter life cycle. The life cycle of a plant is taken to mean the time needed to grow from a dry mature seed up to the stage where the plant has produced dry mature seeds, similar to the starting material. This life cycle may be influenced by factors such as early vigour, growth rate, flowering time and speed of seed maturation. An increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible. If the growth rate is sufficiently increased, it may allow for the sowing of further seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of rice plants followed by, for example, the sowing and optional harvesting of soy bean, potatoes or any other suitable plant). Harvesting additional times from the same rootstock in the case of some plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves plotting growth experiments, such parameters may be: T-Mid (the time taken for plants to reach 50% of their maximal size) and T-90 (time taken for plants to reach 90% of their maximal size), amongst others. The term "flowering time" as used herein shall mean the time period between the start of seed germination and the start of flowering.

Performance of the methods of the invention gives plants having an increased growth rate.

Therefore, according to the present invention, there is provided a method for increasing the growth rate of plants, which method comprises increasing activity in a plant of a SYR polypeptide or a homologue thereof and/or expression of a nucleic acid encoding such a protein.

According to the present invention, there is provided a method for increasing the growth rate of plants, which method comprises modulating (preferably increasing) activity in a plant of an FG-GAP polypeptide or a homologue thereof and/or modulating (preferably increasing) expression of a nucleic acid encoding such protein.

According to the present invention, there is provided a method for increasing the growth rate of plants which method comprises increasing non-constitutive expression in a plant of a nucleic acid encoding a CYP90B polypeptide or a homologue thereof.

According to the present invention, there is provided a method for increasing the growth rate of plants, which method comprises increasing expression in a plant of a nucleic acid encoding a DOF transcription factor polypeptide.

According to the present invention, there is provided a method for increasing the growth rate of plants relative to suitable control plants, which method comprises preferentially reducing expression of an endogenous Cyclin Dependent Kinase Inhibitor (CKI) gene in endosperm tissue of a plant.

An increase in yield and/or seed yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the typical stresses to which a plant may be exposed. These stresses may be the everyday biotic and/or abiotic (environmental) stresses to which a plant is exposed. Typical abiotic or environmental stresses include temperature stresses caused by atypical hot or cold/freezing temperatures; salt stress; water stress (drought or excess water), anaerobic stress, chemical toxicity and oxidative stress. The abiotic stress may be an osmotic stress caused by a water stress (particularly due to drought), salt stress, oxidative stress or an ionic stress. Chemicals may also cause abiotic stresses (for example too high or, too low concentrations of minerals or nutrients). Biotic stresses are typically those stresses caused by pathogens, such as bacteria, viruses, fungi and insects. The term "non-stress conditions" as used herein are those environmental conditions that do not significantly go beyond the everyday climatic and other abiotic conditions that plants may encounter, and which allow optimal growth of the plant. Persons skilled in the art are aware of normal soil conditions and climatic conditions for a given geographic location.

Insofar as the methods of the invention concern SYR, performance of the methods result in plants having increased tolerance to abiotic stress. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. For example, drought and/or salinisation are manifested primarily as osmotic stress, resulting in the disruption of homeostasis and ion distribution in the cell. Oxidative stress, which frequently accompanies high or low temperature, salinity or drought stress may cause denaturation of functional and structural proteins. As a consequence, these diverse environmental stresses often activate similar cell signaling pathways and cellular responses, such as the production of stress proteins, up-regulation of antioxidants, accumulation of compatible solutes and growth arrest.

Since diverse environmental stresses activate similar pathways, the exemplification of the present invention with drought stress (insofar as the invention concerns the use of SYR polypeptides and their encoding nucleic acids) should not be seen as a limitation to drought stress, but more as a screen to indicate the involvement of SYR polypeptides or homologues thereof in abiotic stresses in general. Furthermore, the methods of the present invention may be performed under non-stress conditions or under conditions of mild drought to give plants having improved growth characteristics (particularly increased yield) relative to corresponding wild type or other control plants.

A particularly high degree of "cross talk" is reported between drought stress and high-salinity stress (Rabbani et al. (2003) Plant Physiol 133: 1755-1767). Therefore, it would be apparent that a SYR polypeptide or a homologue thereof would, along with its usefulness in conferring drought-tolerance in plants, also find use in protecting the plant against various other abiotic stresses. Similarly, it would be apparent that a SYR protein (as defined herein) would, along with its usefulness in conferring salt-tolerance in plants, also find use in protecting the plant against various other abiotic stresses. Furthermore, Rabbani et al. (2003, Plant Physiol 133: 1755-1767) report that similar molecular mechanisms of stress tolerance and responses exist between dicots and monocots. The methods of the invention are therefore advantageously applicable to any plant.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any one or more of: NaCl, KCl, LiCl, $MgCl_2$, $CaCl_2$, amongst others.

Increased tolerance to abiotic stress is manifested by increased plant yield in abiotic stress conditions. Insofar as the invention concerns the use of SYR polypeptides and their encoding nucleic acids, such increased yield may include one or more of the following: increased number of filled seeds, increased total seed yield, increased number of flowers per panicle, increased seed fill rate, increased Harvest Index, increased Thousand Kernel Weight, increased root length or increased root diameter, each relative to corresponding wild type plants.

Performance of the methods of the invention gives plants having increased tolerance to abiotic stress. Performance of the methods of the invention gives plants grown under non-stress conditions or under mild drought conditions improved growth characteristics (particularly increased yield and/or increased emergence vigour (or early vigour)) relative to corresponding wild type plants or other control plants grown under comparable conditions.

According to the present invention, there is provided a method for increasing abiotic stress tolerance in plants-which method comprises modulating expression in a plant of a nucleic acid encoding a SYR polypeptide or a homologue thereof. According to one aspect of the invention, the abiotic stress is osmotic stress, selected from one or more of the following: water stress, salt stress, oxidative stress and ionic stress. Preferably, the water stress is drought stress.

The present invention also provides a method for improving abiotic stress tolerance in plants, comprising increasing activity in a plant of a SYR protein or a homologue thereof.

Insofar as the methods of the invention concern DOF transcription factors, the methods may be performed under conditions of mild drought to give plants having increased yield relative to suitable control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signaling pathways and cellular responses, such as the production of stress proteins, up-regulation of anti-oxidants, accumulation of compatible solutes and growth arrest.

Performance of the methods of the invention gives plants grown under mild drought conditions increased yield relative to suitable control plants grown under comparable conditions. Therefore, according to the present invention, there is provided a method for increasing yield in plants grown under mild drought conditions, which method comprises increasing expression in a plant of a nucleic acid encoding a DOF transcription factor polypeptide.

The abovementioned improved growth characteristics may advantageously be improved in any plant. Insofar as the methods of the invention concern the use of AT-hook transcription factors, the methods are applicable to monocotyledonous plants.

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest or the genetic modification in the gene/nucleic acid of interest. The term "plant" also encompasses plant cells, suspension cultures, callus tissue, embryos, meristematic regions, gametophytes, sporophytes, pollen and microspores, again wherein each of the aforementioned comprise the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agropyron* spp., *Allium* spp., *Amaranthus* spp., *Ananas comosus*, *Annona* spp., *Apium graveolens*, *Anachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Capsicum* spp., *Carex elata*, *Carica papaya*, *Carissa macrocarpa*, *Carya* spp., *Catthamus tinctorius*, *Castanea* spp., *Cichorium endivia*, *Cinnamomum* spp., *Citrullus lanatus*, *Citrus* spp., *Cocos* spp., *Coffea* spp., *Colocasia esculenta*, *Cola* spp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eiobotrya japonica*, *Eugenia uniflora*, *Fagopyrum* spp., *Fagus* spp., *Ficus carica*, *Fortuneila* spp., *Fragana* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Momordica* spp., *Morus nigra*, *Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Passiflora edulis, Pastinaca sativa, Persea* spp., *Petroselinum crispum, Phaseolus* spp., *Phoenix* spp., *Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trnfolium* spp., *Triticosecale rimpaui, Triticum* spp. (e.g. *Triticum aestivum, Triticum durum, Triticum turgidum, Triticum hybemum, Triticum macha, Triticum sativum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustnis, Vziphus* spp., amongst others.

Preferably, the plant is a crop plant such as soybean, sunflower, canola, alfalfa, rapeseed, cotton, tomato, potato or tobacco. Further preferably, the plant is a monocotyledonous plant, such as sugarcane. More preferably the plant is a cereal, such as rice, maize, wheat, barley, millet, rye, sorghum or oats.

Where the methods of the invention concern use of an AT-hook transcription factor, the monocotyledonous plant is a cereal, such as rice, maize, sugarcane, wheat, barley, millet, rye, sorghum, grasses or oats.

DEFINITIONS

Polypeptide

The terms "polypeptide" and "protein" are used interchangeably herein and refer to amino acids in a polymeric form of any length. The terms "polynucleotide(s)", "nucleic acid sequence(s)", "nucleotide sequence(s)" are used interchangeably herein and refer to nucleotides, either ribonucleotides or deoxyribonucleotides or a combination of both, in a polymeric form of any length.

Control Plant

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. A control plant as used herein refers not only to whole plants, but also to plant parts, including seeds and seed parts.

Increase, Improve

The terms "increase", "improving" or "improve" are used interchangeably herein and are taken to mean at least a 5%, 6%, 7%, 8%, 9% or 10%, preferably at least 15% or 20%, more preferably 25%, 30%, 35% or 40% more yield and/or growth in comparison to corresponding wild type or other control plants as defined herein.

Hybridisation

The term "hybridisation" as defined herein is a process wherein substantially homologous complementary nucleotide sequences anneal to each other. The hybridisation process may occur entirely in solution, i.e. both complementary nucleic acids are in solution. The hybridisation process may also occur with one of the complementary nucleic acids immobilised to a matrix such as magnetic beads, Sepharose beads or any other resin. The hybridisation process may furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids. The stringency of hybridisation is influenced by conditions such as temperature, salt concentration, ionic strength and hybridisation buffer composition.

"Stringent hybridisation conditions" and "stringent hybridisation wash conditions" in the context of nucleic acid hybridisation experiments such as Southern and Northern hybridisations are sequence dependent and are different under different environmental parameters. The skilled artisan is aware of various parameters which may be altered during hybridisation and washing and which will either maintain or change the stringency conditions.

The $T_m$ is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M. Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the $T_m$ decreases about 1° C. per % base mismatch. The $T_m$ may be calculated using the following equations, depending on the types of hybrids:

DNA-DNA hybrids (Meinkoth and Wahl, Anal. Biochem., 138: 267-284, 1984):

$$T_m = 81.5° C. + 16.6 \times \log [Na^+]^a + 0.41 \times \%[G/C^b] - 500 \times [L^c]^{-1} - 0.61 \times \% \text{ formamide}$$

DNA-RNA or RNA-RNA hybrids:

$$T_m = 79.8 + 18.5(\log_{10}[Na^+]^a) + 0.58(\% G/C^b) + 11.8(\% G/C^b)^2 - 820/L^c$$

oligo-DNA or oligo-RNA$^d$ hybrids:

For <20 nucleotides: $T_m = 2 (I_n)$

For 20-35 nucleotides: $T_m = 22 + 1.46 (I_n)$ $^a$ or for other monovalent cation, but only accurate in the 0.01-0.4 M range.

$^b$ only accurate for % GC in the 30% to 75% range.

$^c$L=length of duplex in base pairs.

$^d$Oligo, oligonucleotide; $I_n$, effective length of primer=(no. of G/C)+(no. of A/T).

Note: for each 1% formamide, the $T_m$ is reduced by about 0.6 to 0.7° C., while the presence of 6M urea reduces the $T_m$ by about 30° C.

Specificity of hybridisation is typically the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. Generally, suitable stringent conditions for nucleic acid hybridisation assays or gene amplification detection procedures are as set forth above. More or less stringent conditions may also be selected. Generally, low stringency conditions are selected to be about 50° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. For example, stringent conditions are those that are at least as stringent as, for example, conditions A-L; and reduced stringency conditions are at least as stringent as, for example, conditions M-R. Non-specific binding may be controlled using any one of a number of known techniques such as, for example, blocking the membrane with protein containing solutions, additions of heterologous RNA, DNA, and SDS to the hybridisation buffer, and treatment with Rnase.

Examples of hybridisation and wash conditions are listed in Table 1:

TABLE 1

| Stringency Condition | Polynucleotide Hybrid± | Hybrid Length (bp)‡ | Hybridization Temperature and Buffer† | Wash Temperature and Buffer† |
|---|---|---|---|---|
| A | DNA:DNA | > or equal to 50 | 65° C. 1xSSC; or 42° C., 1xSSC and 50% formamide | 65° C.; 0.3xSSC |
| B | DNA:DNA | <50 | Tb*; 1xSSC | Tb*; 1xSSC |
| C | DNA:RNA | > or equal to 50 | 67° C. 1xSSC; or 45° C., 1xSSC and 50% formamide | 67° C.; 0.3xSSC |
| D | DNA:RNA | <50 | Td*; 1xSSC | Td*; 1xSSC |
| E | RNA:RNA | > or equal to 50 | 70° C. 1xSSC; or 50° C., 1xSSC and 50% formamide | 70° C.; 0.3xSSC |
| F | RNA:RNA | <50 | Tf*; 1xSSC | Tf*; 1xSSC |
| G | DNA:DNA | > or equal to 50 | 65° C. 4xSSC; or 45° C., 4xSSC and 50% formamide | 65° C.; 1xSSC |
| H | DNA:DNA | <50 | Th*; 4 xSSC | Th*; 4xSSC |
| I | DNA:RNA | > or equal to 50 | 67° C. 4xSSC; or 45° C., 4xSSC and 50% formamide | 67° C.; 1xSSC |
| J | DNA:RNA | <50 | Tj*; 4 xSSC | Tj*; 4 xSSC |
| K | RNA:RNA | > or equal to 50 | 70° C. 4xSSC; or 40° C., 6xSSC and 50% formamide | 67° C.; 1xSSC |
| L | RNA:RNA | <50 | Tl*; 2 xSSC | Tl*; 2xSSC |
| M | DNA:DNA | > or equal to 50 | 50° C. 4xSSC; or 40° C., 6xSSC and 50% formamide | 50° C.; 2xSSC |
| N | DNA:DNA | <50 | Tn*; 6 xSSC | Tn*; 6xSSC |
| O | DNA:RNA | > or equal to 50 | 55° C. 4xSSC; or 42° C., 6xSSC and 50% formamide | 55° C.; 2xSSC |
| P | DNA:RNA | <50 | Tp*; 6 xSSC | Tp*; 6xSSC |
| Q | RNA:RNA | > or equal to 50 | 60° C. 4xSSC; or 45° C., 6xSSC and 50% formamide | 60° C.; 2xSSC |
| R | RNA:RNA | <50 | Tr*; 4 xSSC | Tr*; 4xSSC |

‡The "hybrid length" is the anticipated length for the hybridising nucleic acid. When nucleic acids of known sequence are hybridised, the hybrid length may be determined by aligning the sequences and identifying the conserved regions described herein.
†SSPE (1xSSPE is 0.15M NaCl, 10 mM NaH$_2$PO$_4$, and 1.25 mM EDTA, pH7.4) may be substituted for SSC (1xSSC is 0.15 M NaCl and 15 mM sodium citrate) in the hybridisation and wash buffers; washes are performed for 15 minutes after hybridisation is complete. The hybridisations and washes may additionally include 5 × Denhardt's reagent, 0.5-1.0% SDS, 100 µg/ml denatured, fragmented salmon sperm DNA, 0.5% sodium pyrophosphate, and up to 50% formamide.
*Tb-Tr: The hybridisation temperature for hybrids anticipated to be less than 50 base pairs in length should be 5-10° C. less than the melting temperature $T_m$ of the hybrids; the $T_m$ is determined according to the above-mentioned equations.
±The present invention also encompasses the substitution of any one, or more DNA or RNA hybrid partners with either a PNA, or a modified nucleic acid.

For the purposes of defining the level of stringency, reference may conveniently be made to Sambrook et al. (2001) Molecular Cloning: a laboratory manual, 3$^{rd}$ Edition Cold Spring Harbor Laboratory Press, CSH, New York or to Current Protocols in Molecular Biology, John Wiley & Sons, N.Y. (1989).

T-DNA Activation Tagging

T-DNA activation tagging (Hayashi et al. Science (1992) 1350-1353) involves insertion of T-DNA, usually containing a promoter (may also be a translation enhancer or an intron), in the genomic region of the gene of interest or 10 kb up- or down stream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to overexpression of genes near the inserted T-DNA. The resulting transgenic plants show dominant phenotypes due to overexpression of genes close to the introduced promoter. The promoter to be introduced may be any promoter capable of directing expression of a gene in the desired organism, in this case a plant. For example, constitutive, tissue-preferred, cell type-preferred and inducible promoters are all suitable for use in T-DNA activation.

Tilling

TILLING (Targeted Induced Local Lesions In Genomes) is a mutagenesis technology useful to generate and/or identify and/or to eventually isolate mutagenised variant nucleic acids. TILLING also allows selection of plants carrying such mutant variants. These mutant variants may even exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 1682; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Site-Directed Mutagenesis

Site-directed mutagenesis may be used to generate variants of SYR nucleic acids. Several methods are available to achieve site-directed mutagenesis; the most common being PCR based methods (Current Protocols in Molecular Biology. Wiley Eds. http://www.4ulr.com/products/currentprotocols/index.html).

Transposon Mutagenesis

Transposon mutagenesis is a mutagenesis technique based on the insertion of transposons in genes, which frequently results in gene-knockout. The technique has been used for several plant species, including rice (Greco et al., Plant Physiol, 125, 1175-1177, 2001), corn (McCarty et al., Plant J. 44, 5261, 2005) and *Arabidopsis* (Parinov and Sundaresan, Curr. Opin. Biotechnol. 11, 157-161, 2000).

Directed Evolution

Directed evolution or gene shuffling consists of iterations of DNA shuffling followed by appropriate screening and/or selection to generate variant nucleic acids or portions thereof, or polypeptides or homologues thereof having a modified biological activity (Castle et al., (2004) Science 304(5674): 11514; U.S. Pat. Nos. 5,811,238 and 6,395,547).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2):132-8). The nucleic acid to be targeted (which may be any of the nucleic acids or variant defined herein) needs to be targeted to the particular gene locus. The nucleic acid to be targeted may be an improved allele used to replace the endogenous gene or may be introduced in addition to the endogenous gene.

Homologues

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (such as similar hydrophobicity, hydrophilicity, antigenicity, propensity to form or break α-helical structures or β-sheet structures). Conservative substitution tables are well known in the art (see for example Creighton (1984) Proteins. W.H. Freeman and Company and Table 2 below).

Orthologues and Paralogues

Encompassed by the term "homologues" are orthologous sequences and paralogous sequences, two special forms of homology which encompass evolutionary concepts used to describe ancestral relationships of genes.

The term "paralogous" relates to gene-duplications within the genome of a species leading to paralogous genes. Paralogues may easily be identified by performing a BLAST analysis against a set of sequences from the same species as the query sequence.

The term "orthologous" relates to homologous genes in different organisms due to speciation. Orthologues in, for example, dicot plant species may easily be found by performing a so-called reciprocal blast search. This may be done by a first blast involving blasting a query sequence (for example, SEQ ID NO: 1 or SEQ ID NO: 2) against any sequence database, such as the publicly available NCBI database which may be found at: http://www.ncbi.nim.nih.gov. BLASTN or TBLASTX (using standard default values) may be used when starting from a nucleotide sequence and BLASTP or TBLASTN (using standard default values) may be used when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2 the second blast would therefore be against *Oryza sativa* sequences) The results of the first and second BLASTs are then compared. A paralogue is identified if a high-ranking hit from the second blast is from the same species as from which the query sequence is derived; an orthologue is identified if a high-ranking hit is not from the same species as from which the query sequence is derived. High-ranking hits are those having a low E-value. The lower the E-value, the more significant the score (or in other words the lower the probability that the hit was found by chance). Computation of the E-value is well known in the art. In the case of large families, ClustalW may be used, followed by a neighbour joining tree, to help visualize clustering of related genes and to identify orthologues and paralogues.

A homologue may be in the form of a "substitutional variant" of a protein, i.e. where at least one residue in an amino acid sequence has been removed and a different residue inserted in its place. Amino acid substitutions are typically of single residues, but may be clustered depending upon functional constraints placed upon the polypeptide; insertions will usually be of the order of about 1 to 10 amino acid residues. Preferably, amino acid substitutions comprise conservative amino acid substitutions. Less conserved substitutions may be made in case the above-mentioned amino acid properties are not so critical. Conservative substitution tables are readily available in the art. The table below gives examples of conserved amino acid substitutions.

TABLE 2

Examples of conserved amino acid substitutions:

| Residue | Conservative Substitutions |
|---|---|
| Ala | Ser |
| Arg | Lys |
| Asn | Gln; His |
| Asp | Glu |

TABLE 2-continued

Examples of conserved amino acid substitutions:

| Residue | Conservative Substitutions |
|---------|---------------------------|
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

A homologue may also be in the form of an "insertional variant" of a protein, i.e. where one or more amino acid residues are introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-tag, glutathione S-transferase-tag, protein A, maltose-binding protein, dihydrofolate reductase, Tag-100 epitope, c-myc epitope, FLAG®-epitope, lacZ, CMP (calmodulin-binding peptide), HA epitope, protein C epitope and VSV epitope.

Homologues in the form of "deletion variants" of a protein are characterised by the removal of one or more amino acids from a protein.

Amino acid variants of a protein may readily be made using peptide synthetic techniques well known in the art, such as solid phase peptide synthesis and the like, or by recombinant DNA manipulations. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" are polypeptides or proteins which may comprise naturally modified and/or non-naturally modified amino acid residues compared to the amino acid sequence of a naturally-occurring form (that is not having undergone post-translational modifications) of the protein, for example, as presented in SEQ ID NO: 2. "Derivatives" of a protein encompass polypeptides or proteins which may comprise naturally occurring altered, glycosylated, acylated, prenylated or non-naturally occurring amino acid residues compared to the amino acid sequence of a naturally-occurring form of the polypeptide. A derivative may also comprise one or more non-amino acid substituents compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein.

Alternative Splice Variants

The term "alternative splice variant" as used herein encompasses variants of a nucleic acid sequence in which selected introns and/or exons have been excised, replaced or added, or in which introns have been shortened or lengthened. Such variants will be ones in which the biological activity of the protein is retained, which may be achieved by selectively retaining functional segments of the protein. Such splice variants may be found in nature or may be manmade. Methods for making such splice variants are known in the art.

Allelic Variant

Allelic variants exist in nature, and encompassed within the methods of the present invention is the use of these natural alleles. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Promoter

The terms regulatory element, "control sequence" and "promoter" are all used interchangeably herein and are to be taken in a broad context to refer to regulatory nucleic acid sequences capable of effecting expression of the sequences to which they are ligated. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ. The term "operably linked" as used herein refers to a functional linkage between the promoter sequence and the gene of interest, such that the promoter sequence is able to initiate transcription of the gene of interest.

The promoter may be an inducible promoter, i.e. having induced or increased transcription initiation in response to a developmental, chemical, environmental or physical stimulus.

A tissue-preferred or tissue-specific promoter is one that is capable of preferentially initiating transcription in certain tissues, such as the leaves, roots, seed tissue etc, or even in specific cells.

The term "constitutive" as defined herein refers to a promoter that is expressed predominantly in at least one tissue or organ and predominantly at any life stage of the plant. Preferably the promoter is expressed predominantly throughout the plant.

Examples of other constitutive promoters are shown in Table 3 below.

TABLE 3

Examples of constitutive promoters

| Gene Source | Reference |
| --- | --- |
| Actin | McElroy et al, Plant Cell, 2: 163-171, 1990 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain at al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

TABLE 4

Examples of non-constitutive promoters

| Gene source and name | Expression Pattern | Reference |
| --- | --- | --- |
| Rice RP6 | Endosperm-specific | Wen et al. (1993) Plant Physiol 101(3): 1115-6 |
| Sorghum kafirin | Endosperm-specific | DeRose et al. (1996) Plant Molec Biol 32: 1029-35 |
| Corn zein | Endosperm-specific | Matzke et al. (1990) Plant Mol Biol 14(3): 323-32 |
| Rice Oleosin 18 kDa | Embryo (and aleurone) specific | Chuang et al. (1996) J Biochem 120(1): 74-81 |
| Rice Oleosin 16 kDa | Embryo (and aleurone) specific | Chuang et al. (1996) J Biochem 120(1): 74-81 |
| Soybean beta-conglycinin | Embryo | Chiera et al. (2005) Plant Molec Biol 56(6): 895-904 |
| Rice Wsi18 | Whole seed | Joshee et al. (1998) Plant Cell Physiol 39(1): 64-72. |
| Rice | Whole seed | Sasaki et al. (2002) NCBI accession number BAA85411 |
| Rice OSH1 | Early shoot apical meristem | Sato et al. (1996) Proc Natl Acad Sci 93 (15): 8117-8122 |
| Rice Rcc2 | Root-specific | Xu et al. (1995) Plant Mol Biol 27(2): 237-48 |
| Rice Rcc3 | Root-specific | Xu et al. (1995) Plant Mol Biol 27(2): 237-48 |
| *Arabidopsis* Pyk10 | Root-specific | Nitz et al. (2001) Plant Sci 161(2): 337-346 |

TABLE 5

Examples of early shoot apical meristem promoters

| Gene source | Gene family | Plant source | Reference |
| --- | --- | --- | --- |
| OSH1 | KNOX family class 1 homeobox | *Oryza sativa* | Matsuoka et al., (1993) Plant Cell 5: 1039-1048<br>Sato et al., (1996) PNAS 93: 8117-8122 |
| Knotted1 | KNOX family class 1 homeobox | *Zea mays* | Hake et al., (1989) EMBO Journal 8: 15-22 |
| KNAT1 | KNOX family class 1 homeobox | *Arabidopsis thaliana* | Lincoln et al., (1994) Plant Cell 6: 1859-1876 |
| Oskn2 | KNOX family class 1 homeobox | *Oryza sativa* | Postma-Haarsma et al., (1999) Plant Mol Biol 39(2): 257-71 |
| Oskn3 | KNOX family class 1 homeobox | *Oryza sativa* | Postma-Haarsma et al., (1999) Plant Mol Biol 39(2): 257-71 |

TABLE 6

Examples of endosperm-specific promoters for use in the present invention

| Gene source | Expression pattern | Reference |
|---|---|---|
| wheat LMW and HMW glutenin-1 | endosperm | Mol Gen Genet 216: 81-90, 1989; NAR 17: 461-2, 1989. |
| wheat α, β, γ-gliadins | endosperm | EMBO 3: 1409-15, 1984. |
| barley ltr1 promoter | endosperm | |
| barley B1, C, D, hordein | endosperm | Theor Appl Gen 98: 1253-62, 1999; Plant J 4: 343-55, 1993; Mol Gen Genet 250: 750-60, 1996. |
| barley DOF | endosperm | Mena et al., The Plant Journal, 116(1): 53-62, 1998. |
| blz2 | endosperm | EP99106056.7 |
| synthetic promoter | endosperm | Vicente-Carbajosa et al., Plant J. 13: 629-640, 1998. |
| rice prolamin NRP33 | endosperm | Wu et al., Plant Cell Physiology 39(8) 885-889, 1998. |
| rice α-globulin Glb-1 | endosperm | Wu et al., Plant Cell Physiology 39(8) 885-889, 1998. |
| rice α-globulin REB/OHP-1 | endosperm | Nakase et al., Plant Mol. Biol. 33: 513-522, 1997. |
| rice ADP-glucose PP | endosperm | Trans Res 6: 157-68, 1997. |
| maize ESR gene family | endosperm | Plant J 12: 235-46, 1997. |
| sorgum γ-kafirin | endosperm | PMB 32: 1029-35, 1996. |

TABLE 7

Examples of seed-specific promoters for use in the present invention

| Gene source | Expression pattern | Reference |
|---|---|---|
| seed-specific genes | seed | Simon, et al., Plant Mol. Biol. 5: 191, 1985; Scofield, et al., J. Biol. Chem. 262: 12202, 1987; Baszczynski, et al., Plant Mol. Biol. 14: 633, 1990. |
| Brazil Nut albumin | seed | Pearson, et al., Plant Mol. Biol. 18: 235-245, 1992. |
| legumin | seed | Ellis, et al., Plant Mol. Biol. 10: 203-214, 1988. |
| glutelin (rice) | seed | Takaiwa, et al., Mol. Gen. Genet. 208: 15-22, 1986; Takaiwa, et al., FEBS Letts. 221: 43-47, 1987. |
| zein | seed | Matzke et al., Plant Mol Biol, 14(3): 323-32, 1990. |
| napA | seed | Stalberg, et al., Planta 199: 515-519, 1996. |
| wheat LMW and HMW glutenin-1 | endosperm | Mol Gen Genet 216: 81-90, 1989; NAR 17: 461-2, 1989. |
| wheat SPA | seed | Albani et al., Plant Cell, 9: 171-184, 1997. |
| wheat α, β, γ-gliadins | endosperm | EMBO 3: 1409-15, 1984. |
| barley ltr1 promoter | endosperm | |
| barley B1, C, D, hordein | endosperm | Theor Appl Gen 98: 1253-62, 1999; Plant J 4: 343-55, 1993; Mol Gen Genet 250: 750-60, 1996. |
| barley DOF | endosperm | Mena et al., The Plant Journal, 116(1): 53-62, 1998. |
| blz2 | endosperm | EP99106056.7 |
| synthetic promoter | endosperm | Vicente-Carbajosa et al., Plant J. 13: 629-640, 1998. |
| rice prolamin NRP33 | endosperm | Wu et al., Plant Cell Physiology 39(8) 885-889, 1998. |
| rice α-globulin Glb-1 | endosperm | Wu et al., Plant Cell Physiology 39(8) 885-889, 1998. |
| rice OSH1 | embryo | Sato et al., Proc. Natl. Acad. Sci. USA, 93: 8117-8122, 1996. |
| rice α-globulin REB/OHP-1 | endosperm | Nakase et al., Plant Mol. Biol. 33: 513-522, 1997. |
| rice ADP-glucose PP | endosperm | Trans Res 6: 157-68, 1997. |
| maize ESR gene family | endosperm | Plant J 12: 235-46, 1997. |
| sorgum γ-kafirin | endosperm | PMB 32: 1029-35, 1996. |
| KNOX | embryo | Postma-Haarsma et al., Plant Mol. Biol. 39: 257-71, 1999. |
| rice oleosin | embryo and aleurone | Wu et al., J. Biochem., 123: 386, 1998. |
| sunflower oleosin | seed (embryo and dry seed) | Cummins et al., Plant Mol. Biol. 19: 873-876, 1992. |

Terminator Sequence

The term "terminator" encompasses a control sequence which is a DNA sequence at the end of a transcriptional unit which signals 3' processing and polyadenylation of a primary transcript and termination of transcription. Additional regulatory elements may include transcriptional as well as translational enhancers. Those skilled in the art will be aware of terminator and enhancer sequences that may be suitable for use in performing the invention. Such sequences would be known or may readily be obtained by a person skilled in the art.

Selectable Marker

The term "selectable marker gene" as referred to herein includes any gene that confers a phenotype on a cell in which it is expressed to facilitate the identification and/or selection of cells that are transfected or transformed with a nucleic acid construct of the invention. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin), to herbicides (for example bar which provides resistance to Basta™; aroA or gox providing resistance against glyphosate), or genes that provide a metabolic trait (such as manA that allows plants to use mannose as sole carbon source). Visual marker genes result in the formation of colour (for example β-glucuronidase, GUS), luminescence (such as luciferase) or fluorescence (Green Fluorescent Protein, GFP, and derivatives thereof).

Transformation

The term "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated from there. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

Transformation of plant species is now a fairly routine technique. Advantageously, any of several transformation methods may be used to introduce the gene of interest into a suitable ancestor cell. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic rice plants are preferably produced via Agrobacterum-mediated transformation using any of the well known methods for rice transformation, such as described in any of the following: published European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth.

Generally after transformation, plant cells or cell groupings are selected for the presence of one or more markers which are encoded by plant-expressible genes co-transferred with the gene of interest, following which the transformed material is regenerated into a whole plant.

Following DNA transfer and regeneration, putatively transformed plants may be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques.

The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

Detailed Description Seed Yield Regulator (SYR)

The activity of a SYR protein may be increased by increasing levels of the SYR polypeptide. Alternatively, activity may also be increased when there is no change in levels of a SYR, or even when there is a reduction in levels of a SYR protein. This may occur when the intrinsic properties of the polypeptide are altered, for example, by making a mutant or selecting a variant that is more active that the wild type.

The term "SYR protein or homologue thereof" as defined herein refers to a polypeptide of about 65 to about 200 amino acids, comprising (i) a leucine rich domain that resembles a leucine zipper in the C-terminal half of the protein, which leucine rich domain is (ii) preceded by a tripeptide with the sequence YFS (conserved motif 1a, SEQ ID NO: 6), or YFT (conserved motif 1b, SEQ ID NO: 7), or YFG (conserved motif 1c, SEQ ID NO: 8) or YLG (conserved motif 1d, SEQ ID NO: 9), and (iii) followed by a conserved motif 2 ((V/A/I)LAFMP(T/S), SEQ ID NO: 10). Preferably, the conserved motif 2 is (A/V)LAFMP(T/S) (SEQ ID NO: 10), most preferably, the conserved motif is VLAFMPT (SEQ ID NO: 10). The "SYR protein or homologue thereof" preferably also has a conserved C-terminus peptide ending with the conserved motif 3 (SYL or PYL, SEQ ID NO: 11). The leucine rich domain of the SYR protein or its homologue is about 38 to 48 amino acids long, starting immediately behind the conserved motif 1 and stopping immediately before the conserved motif 2, and comprises at least 30% of leucine. The Leu rich domain preferably has a motif that resembles the Leucine Zipper motif (L-$X_6$-L-$X_6$-L-$X_6$-L, (SEQ ID NO: 287) wherein $X_6$ is a sequence of 6 consecutive amino acids). A preferred example of a SYR protein is represented by SEQ ID NO: 2, an overview of its domains is given in FIG. 1. It should be noted that the term "SYR protein or homologue thereof" does not encompass the ARGOS protein from *Arabidopsis thaliana* (SEQ ID NO: 26).

Further preferably, SYR proteins have two transmembrane domains, with the N-terminal part and C-terminal part of the protein located inside and the part between the transmembrane domains located outside.

Alternatively, the homologue of a SYR protein has in increasing order of preference at least 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises the conserved motifs 1 (a, b, c or d), 2 and 3, and the leucine rich domain as outlined above. The overall sequence identity is determined using a global alignment algorithm, such as the Needleman Wunsch algorithm in the program GAP (GCG Wisconsin Package, Accelrys), preferably with default parameters.

The various structural domains in a SYR protein may be identified using specialised databases e.g. SMART (Schultz et al. (1998) Proc. Natl. Acad. Sci. USA 95, 5857-5864; Letunic et al. (2002) Nucleic Acids Res 30, 242-244; http://smart.embl-heidelberg.de/), InterPro (Mulder et al., (2003) Nucl. Acids. Res. 31, 315-318; http://www.ebi.ac.uk/interpro/), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), http://www.expasy.org/prosite/) or Pfam (Bateman et al., Nucleic Acids Research 30(1):276-280 (2002), http://www.sanger.ac.uktSoftware/Pfam/).

Methods for the search and identification of SYR homologues would be well within the realm of persons skilled in the art. Such methods comprise comparison of the sequences represented by SEQ ID NO: 1 or 2, in a computer readable format, with sequences that are available in public databases such as MIPS (http://mips.gsf.deI), GenBank (http://www.ncbi.nim.nih.gov/Genbank/index.html) or EMBL Nucleotide Sequence Database (http://www.ebi.ac.uk/embl/index.html), using algorithms well known in the art for the alignment or comparison of sequences, such as GAP (Needleman and Wunsch, J. Mol. Biol. 48; 443-453 (1970)), BESTFIT (using the local homology algorithm of Smith and Waterman (Advances in Applied Mathematics 2; 482-489 (1981))), BLAST (Altschul, S. F., Gish, W., Miller, W., Myers, E. W. & Lipman, D. J., J. Mol. Biol. 215:403-410 (1990)), FASTA and TFASTA (W. R. Pearson and D. J. Lipman Proc.Natl. Acad. Sci. USA 85:2444-2448 (1988)). The software for performing BLAST analysis is publicly available through the National Centre for Biotechnology Information (NCBI).

Transmembrane domains are about 15 to 30 amino acids long and are usually composed of hydrophobic residues that form an alpha helix. They are usually predicted on the basis of hydrophobicity (for example Klein et al., Biochim. Biophys. Acta 815, 468, 1985; or Sonnhammer et al., In J. Glasgow, T. Littlejohn, F. Major, R. Lathrop, O, Sankoff, and C. Sensen, editors, Proceedings of the Sixth International Conference on Intelligent Systems for Molecular Biology, pages 175-182, Menlo Park, Calif., 1998. AAAI Press).

Examples of proteins falling under the definition of "SYR polypeptide or a homologue thereof" are listed in Table A of Example 1 and include sequences from various monocotyledonous plants, such as rice (SEQ ID NO: 2, SEQ ID NO: 12 and SEQ ID NO: 13), corn (SEQ ID NO: 14 and SEQ ID NO: 44), wheat (SEQ ID NO: 15), barley (SEQ ID NO: 16), sugarcane (SEQ ID NO: 17 and SEQ ID NO: 18), sorghum (SEQ ID NO: 19); and from dicotyledonous plants such as *Arabidopsis* (SEQ ID NO: 20 and SEQ ID NO: 21), grape (SEQ ID NO: 22), citrus (SEQ ID NO: 23) or tomato (SEQ ID NO: 24 and SEQ ID NO: 25). It is envisaged that the Leu rich domain is important for the function of the protein, hence proteins with the Leu rich domain but without the conserved motifs 1 or 2 may be useful as well in the methods of the present invention; examples of such proteins are given in SEQ ID NO: 34 and 35.

It is to be understood that the term "SYR polypeptide or a homologue thereof" is not to be limited to the sequence represented by SEQ ID NO: 2 or to the homologues listed as SEQ ID NO: 12 to SEQ ID NO: 25, but that any polypeptide of about 65 to about 200 amino acids meeting the criteria of comprising a leucine rich domain as defined above, preceded by the conserved tripeptide motif 1 (a, b, c or d) and followed by the conserved motif 2 and preferably also by the conserved motif 3; or having at least 38% sequence identity to the sequence of SEQ ID NO: 2, may be suitable for use in the methods of the invention.

In another embodiment, the present invention provides an isolated SYR protein selected from the group consisting of:
 (a) a polypeptide as given in SEQ ID NO 44,
 (b) a polypeptide with an amino acid sequence which has at least, in increasing order of preference, 85%, 86%, 87%, 88%, 89%, 90%, 91%, 92%, 93%, 94%, 95%, 96%, 97%, 98% or 99% sequence identity to the amino acid sequence as given in SEQ ID NO 44,
 (c) a derivative of a protein as defined in (a) or (b).

The sequence represented by SEQ ID NO: 43 was hitherto unknown as a SYR encoding gene. There is therefore provided an isolated nucleic acid sequence comprising:
 (i) a nucleic acid sequence represented by SEQ ID NO: 43, or the complement strand thereof;
 (ii) a nucleic acid sequence encoding the amino acid sequence represented by SEQ ID NO: 44;
 (iii) a nucleic acid sequence capable of hybridising (preferably under stringent conditions) with a nucleic acid sequence of (i) or (ii) above, which hybridising sequence preferably encodes a SYR protein;
 (iv) a nucleic acid which is an allelic variant to the nucleic acid sequences according to (i) or (ii);
 (v) a nucleic acid which is a splice variant to the nucleic acid sequences according to (i) or (ii);
 (vi) a nucleic acid sequence which has 50%, 60%, 70%, 75%, 80%, 85%, 90%, 95%, 96%, 97%, 98% or 99% sequence identity to the sequence defined in (i) or (ii).

The activity of a SYR protein or homologue thereof may be assayed by expressing the SYR protein or homologue thereof under control of a GOS2 promoter in *Oryza sativa*, which results in plants with increased increased seed yield without a delay in flowering time when compared to corresponding wild type plants. This increase in seed yield may be measured in several ways, for example as an increase of total seed weight, number of filled seeds or harvest index.

A SYR protein or homologue thereof is encoded by a SYR nucleic acid/gene. Therefore the term "SYR nucleic acid/gene" as defined herein is any nucleic acid/gene encoding a SYR protein or a homologue thereof as defined above.

Examples of SYR nucleic acids include but are not limited to those represented by any one of SEQ ID NO: 1, SEQ ID NO: 27 to SEQ ID NO: 32, SEQ ID NO: 36 to 42 and SEQ ID NO: 44. See also the list of nucleic acids mentioned in Table A of Example 1.

SYR nucleic acids/genes and variants thereof may be suitable in practising the methods of the invention. Variant SYR nucleic acid/genes include portions of a SYR nucleic acid/gene and/or nucleic acids capable of hybridising with a SYR nucleic acid/gene.

The term portion as defined herein refers to a piece of DNA encoding a polypeptide of about 65 to about 200 amino acids, comprising a leucine rich domain as defined above, preceded by the conserved tripeptide motif 1 (a, b, c or d) and followed by the conserved motif 2 and preferably also by the conserved motif 3. Preferably, the portion comprises one or more of the conserved motifs defined above. A portion may be prepared, for example, by making one or more deletions to a SYR nucleic acid. The portions may be used in isolated form or they may be fused to other coding (or non coding) sequences in order to, for example, produce a protein that combines several activities. When fused to other coding sequences, the resulting polypeptide produced upon translation may be bigger than that predicted for the SYR fragment. Preferably, the portion is a portion of a nucleic acid as represented by any one of SEQ ID NO: 1, SEQ ID NO: 27 to SEQ ID NO: 32, SEQ ID NO: 36 to SEQ ID NO: 42 and SEQ ID NO: 44. Most preferably the portion of a nucleic acid is as represented by SEQ ID NO: 1.

Another variant of a SYR nucleic acid/gene is a nucleic acid capable of hybridising under reduced stringency conditions, preferably under stringent conditions, with a SYR nucleic acid/gene as hereinbefore defined, which hybridising sequence encodes a polypeptide of about 65 to about 200 amino acids, comprising a leucine rich domain as defined above, preceded by the conserved tripeptide motif 1 (a, b, c or d) and followed by the conserved motif 2 and preferably also by the conserved motif 3; or having at least 38% sequence identity to the sequence of SEQ ID NO: 2.

Preferably, the hybridising sequence is one that is capable of hybridising to a nucleic acid as represented by SEQ ID NO: 1, SEQ ID NO: 27 to SEQ ID NO: 32, SEQ ID NO: 36 to SEQ ID NO: 42 and SEQ ID NO: 44, or to a portion of any of the aforementioned sequences. Most preferably the hybridising sequence is capable of hybridising to SEQ ID NO: 1. The term "hybridisation" is as defined herein.

The SYR nucleic acid or variant thereof may be derived from any natural or artificial source. The nucleic acid/gene or variant thereof may be isolated from a microbial source, such as yeast or fungi, or from a plant, algal or animal (including human) source. This nucleic acid may be modified from its native form in composition and/or genomic environment through deliberate human manipulation. The nucleic acid is preferably of plant origin, whether from the same plant species (for example to the one in which it is to be introduced) or whether from a different plant species. The nucleic acid may be isolated from a monocotyledonous species, preferably from the family Poaceae, further preferably from Oryza sativa. More preferably, the SYR nucleic acid is isolated from Oryza sativa and is represented by SEQ ID NO: 1, and the SYR amino acid sequence is as represented by SEQ ID NO: 2.

The expression of a nucleic acid encoding a SYR polypeptide or a homologue thereof may be modulated by introducing a genetic modification (preferably in the locus of a SYR gene). The locus of a gene as defined herein is taken to mean a genomic region, which includes the gene of Interest and 10 kb up- or down stream of the coding region.

The genetic modification may be introduced, for example, by any one (or more) of the following methods: T-DNA activation, TILLING, site-directed mutagenesis, transposon mutagenesis, directed evolution and homologous recombination or by introducing and expressing in a plant a nucleic acid encoding a SYR polypeptide or a homologue thereof. The aforementioned methods are defined herein in the section headed "Definitions". Following introduction of the genetic modification, there follows a step of selecting for modified expression of a nucleic acid encoding a SYR polypeptide or a homologue thereof, which modification in expression gives plants having increased seed yield.

T-DNA activation, TILLING, site-directed mutagenesis, transposon mutagenesis and directed evolution are examples of technologies that enable the generation of novel alleles and SYR variants.

A preferred method for introducing a genetic modification (which in this case need not be in the locus of a SYR gene) is to introduce and express in a plant a nucleic acid encoding a SYR polypeptide or a homologue thereof, as defined herein in. The nucleic acid to be introduced into a plant may be a full-length nucleic acid or may be a portion or a hybridising sequence as hereinbefore defined.

"Homologues" of a protein are defined herein in the section headed "Definitions". The SYR polypeptide or homologue thereof may be a derivative. For a definition of the term "derivative" see the section herein headed "Definitions".

The SYR polypeptide or homologue thereof may be encoded by an alternative splice variant of a SYR nucleic acid/gene. The term "alternative splice variant" is defined in the "Definitions" section. Preferred splice variants are splice variants of the nucleic acid encoding a polypeptide of about 65 to about 200 amino acids, comprising a leucine rich domain as defined above, preceded by the conserved tripeptide motif 1 (a, b, c or d) and followed by the conserved motif 2 and preferably also by the conserved motif 3; or having at least 38% sequence identity to the sequence of SEQ ID NO: 2. Further preferred are splice variants represented by SEQ ID NO: 1, SEQ ID NO: 27 to SEQ ID NO: 32, SEQ ID NO: 36 to SEQ ID NO: 42 and SEQ ID NO: 44. Most preferred is the splice variant represented by SEQ ID NO: 1.

The homologue may also be encoded by an allelic variant of a nucleic add encoding a SYR polypeptide or a homologue thereof, preferably an allelic variant of a nucleic acid encoding a polypeptide of about 65 to about 200 amino acids, comprising a leucine rich domain as defined above, preceded by the conserved tripeptide motif 1 (a, b, c or d) and followed by the conserved motif 2 and preferably also by the conserved motif 3; or having at least 38% sequence identity to the sequence of SEQ ID NO: 2. Further preferably, the allelic variant encoding the SYR polypeptide is represented by any one of SEQ ID NO: 1, or SEQ ID NO: 12 to SEQ ID NO: 25. Most preferably, the allelic variant encoding the SYR polypeptide is as represented by SEQ ID NO: 1. The term "allelic variant" is defined in the "Definitions" section.

According to a preferred aspect of the present invention, increased expression of the SYR nucleic acid or variant thereof is envisaged. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a SYR nucleic acid or variant thereof. For example, endogenous promoters may be altered in vivo by mutation, deletion, and/or substitution (see, Klmiec, U.S. Pat. No. 5,565,350; Zarling et al., PCT/US93/03868), or isolated promoters may be introduced into a plant cell in the proper orientation and distance from a gene of the present invention so as to control the expression of the gene. Methods for reducing the expression of genes or gene products are well documented in the art.

If polypeptide expression is desired, it is generally desirable to include a polyadenylation region at the 3'-end of a polynucleotide-coding region. The polyadenylation region may be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold, Buchman and Berg, Mol. Cell. biol. 8:4395-4405 (1988); Callis et al., Genes Dev. 1:1183-1200 (1987). Such intron enhancement of gene expression is typically greatest when placed near the 5' end of the transcription unit. Use of the maize introns Adh1-S intron 1, 2, and 6, the Bronze-1 intron are known in the art. See generally, The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention.

Therefore, there is provided a gene construct comprising:
(i) a SYR nucleic acid or variant thereof, as defined hereinabove;
(ii) one or more control sequences capable of driving expression of the nucleic acid sequence of (i); and optionally
(iii) a transcription termination sequence;
with the proviso that the gene construct does not comprise a nucleic acid sequence encoding the protein of SEQ ID NO: 26.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells.

Plants are transformed with a vector comprising the sequence of interest (i.e., a nucleic acid encoding a SYR polypeptide or homologue thereof). The sequence of interest is operably linked to one or more control sequences (at least to a promoter). The terms "regulatory element", "control sequence" and "promoter" are all used interchangeably herein and are defined herein in the section headed "Definitions".

Advantageously, any type of promoter may be used to drive expression of the nucleic acid sequence. Preferably, the SYR nucleic acid or functional variant thereof is operably linked to a constitutive promoter. Preferably, the constitutive promoter capable of preferentially expressing the nucleic acid throughout the plant has a comparable expression profile to a GOS2 promoter. More preferably, the constitutive promoter has the same expression profile as the rice GOS2 promoter, most preferably, the promoter capable of preferentially expressing the nucleic acid throughout the plant is the GOS2 promoter from rice (SEQ ID NO: 5).

It should be clear that the applicability of the present invention is not restricted to the SYR nucleic acid represented by SEQ ID NO: 1, nor is the applicability of the invention restricted to expression of a SYR nucleic acid when driven by a GOS2 promoter. An alternative constitutive promoter that is useful in the methods of the present invention is the High Mobility Group Protein (HMGP) promoter (SEQ ID NO: 33). Examples of other constitutive promoters that may also be used to drive expression of a SYR nucleic acid are shown in Table 3 in the section headed "Definitions".

Optionally, one or more terminator sequences may also be used in the construct introduced into a plant. The term "terminator" is defined in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene, as defined in the "Definitions" section.

The present invention also encompasses plants obtainable by the methods according to the present invention. The present invention therefore provides plants obtainable by the method according to the present invention, which plants have introduced therein a SYR nucleic acid or variant thereof, as defined above.

The invention also provides a method for the production of transgenic plants having increased seed yield, comprising introduction and expression in a plant of a SYR nucleic acid or a variant thereof as defined above.

More specifically, the present invention provides a method for the production of transgenic plants having increased seed yield, which method comprises:
(i) introducing and expressing in a plant or plant cell a SYR nucleic acid or variant thereof, and
(ii) cultivating the plant cell under conditions promoting plant growth and development;
with the proviso that the SYR nucleic acid or variant thereof is not a nucleic acid sequence encoding the protein of SEQ ID NO: 26.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is defined in the "Definitions" section.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention. The invention also includes host cells containing an isolated SYR nucleic acid or variant thereof. Preferred host cells according to the invention are plant cells. The invention also extends to harvestable parts of a plant such as, but not limited to seeds, leaves, fruits, flowers, stem cultures, rhizomes, tubers and bulbs. The invention furthermore relates to products directly derived from a harvestable part of such a plant, such as dry pellets or powders, oil, fat and fatty acids, starch or proteins.

The present invention also encompasses use of SYR nucleic acids or variants thereof and use of SYR polypeptides or homologues thereof.

One such use relates to improving the growth characteristics of plants, in particular in improving seed yield. The seed yield may include one or more of the following: increased total weight of seeds, increased number of filled seeds, fill rate and increased harvest index.

SYR nucleic acids or variants thereof, or SYR polypeptides or homologues thereof may find use in breeding programmes in which a DNA marker is identified which may be genetically linked to a SYR gene or variant thereof. The SYR nucleic acids/genes or variants thereof, or SYR polypeptides or homologues thereof may be used to define a molecular marker. This DNA or protein marker may then be used in breeding programmes to select plants having increased seed yield. The SYR gene or variant thereof may, for example, be a nucleic acid as represented by any one of SEQ ID NO: 1, SEQ ID NO: 27 to SEQ ID NO: 32, SEQ ID NO: 36 to SEQ ID NO: 42 and SEQ ID NO: 44.

Allelic variants of a SYR nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased seed yield. Selection is typically carried out by monitoring growth performance of plants containing different allelic variants of the sequence in question, for example, different allelic variants of any one of SEQ ID NO: 1, SEQ. ID NO: 27 to SEQ ID NO: 32, SEQ ID NO: 36 to SEQ ID NO: 42 and SEQ ID NO: 44. Growth performance may be monitored in a greenhouse or in the field. Further optional steps include crossing plants, in which the superior allelic variant was identified, with another plant. This could be used, for example, to make a combination of interesting phenotypic features.

A SYR nucleic acid or variant thereof may also be used as probes for genetically and physically mapping the genes that they are a part of, and as markers for traits linked to those genes. Such information may be useful in plant breeding in order to develop lines with desired phenotypes. Such use of SYR nucleic acids or variants thereof requires only a nucleic acid sequence of at least 15 nucleotides in length. The SYR nucleic acids or variants thereof may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the SYR nucleic acids or variants thereof. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the SYR nucleic acid or variant thereof in the genetic map previously obtained using this population (Botstein et al. (1980) Am. J. Hum. Genet. 32: 314-331).

The production and use of plant gene-derived probes for use in genetic mapping is described in Bernatzky and Tanksley (GENETICS 112 (4): 887-898, 1986). Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et at In: Non-mammalian Genomic Analysis: A Practical Guide, Academic press 1996, pp. 319-346, and references cited therein).

In another embodiment, the nucleic acid probes may be used in direct fluorescence in situ hybridization (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design, of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having increased seed yield, as described hereinbefore. These advantageous growth characteristics may also be combined with other economically advantageous traits, such as further yield-enhancing traits, tolerance to various stresses in addition to the abiotic stress resistance, traits modifying various architectural features and/or biochemical and/or physiological features.

Detailed Description FG-GAP

The activity of an FG-GAP protein may be modulated by modulating levels of the FG-GAP polypeptide. Alternatively, activity may also be modulated when there is no change in levels of an FG-GAP. This may occur when the intrinsic properties of the polypeptide are altered, for example, by making a mutant or selecting a variant that is more active or less active than the wild type.

The term "FG-GAP protein or homologue thereof" as defined herein refers to a polypeptide comprising (i) an N-terminal secretion signal peptide, (ii) one or more FG-GAP domains followed by (iii) a transmembrane domain in the C-terminal half of the protein. An example is given in FIG. 6.

Signal peptides are typical for proteins that are directed to the secretory pathway. The presence of a secretion signal may be easily predicted using computer algorithms (for example SignalP 3.0, Bendtsen et al., J. Mol. Biol., 340:783-795, 2004). A typical secretion signal consists of a positively charged n-region, followed by a hydrophobic n-region and a neutral, polar c-region. Furthermore, the amino acid residues at position −3 and −1 relative to the cleavage site are usually small and neutral.

Transmembrane domains are about 15 to 30 amino acids long and are usually composed of hydrophobic residues that form an alpha helix. They are usually predicted on the basis of hydrophobicity (for example Klein et al., Biochim. Biophys. Acta 815, 468, 1985; or Sonnhammer et al., In J. Glasgow, T. Littlejohn, F. Major, R. Lathrop, D. Sankoff, and C. Sensen, editors, Proceedings, of the Sixth International Conference on Intelligent Systems for Molecular Biology, pages 175-182, Menlo Park, Calif., 1998. AMI Press).

The FG-GAP domain (Pfam accession number PF01839, INTERPRO entry IPR000413) is typically found in integrins where it is present as a repeat (up to 7 copies) in the extracellular part of the protein. So far, only integrins from animal origin have been well characterised. The consensus sequence for the FG-GAP domain is given in SEQ ID NO: 53:

fgssvaagDlnGDGrpDlvvgaPgadggtdgsvyll,
wherein the capital letters represent the single letter amino acid code for highly conserved amino acids and the other letters represent the single letter amino acid code for less conserved amino acids. The domain often comprises a Phe-Gly-$X_n$-Gly-Ala-Pro (SEQ ID NO: 288) motif wherein $X_n$ represents a variable number of amino acids. Because this consensus sequence is derived form animal proteins, it does not entirely match with the plant FG-GAP domain sequences. For example, the hexapeptide "Pgadgg" (SEQ ID NO: 289) may not be present in plant FG-GAP domains. Therefore, the term "FG-GAP domain" as used herein encompasses SEQ ID NO: 53 and sequences that have at least 40% sequence similarity to SEQ ID NO: 53, upon alignment of SEQ ID NO: 53 and the corresponding matching sequence, using the Needleman & Wunsch algorithm with a gap opening penalty of 10 and a gap elongation penalty of 0.5.

The FG-GAP domain may also comprise a Ca2+ binding site.

Preferably, the FG-GAP protein also comprises a FDGY-LYLI(D/E)G motif 1 (SEQ ID NO: 50). More preferably, the conserved motif 1 is FDGYLYLIDG (SEQ ID NO: 50).

Additionally and/or alternatively, the FG-GAP protein may comprise one or more DGXX(D/E) motifs (conserved motif 2, SEQ ID NO: 51), wherein X may be any amino acid. This conserved motif may be part of a larger motif DXDXDGXX(D/E) (conserved motif 3, SEQ ID NO: 52), wherein X may be any amino acid. Thus, the FG-GAP protein preferably comprises one or more copies of the conserved motif 3.

Alternatively, the homologue of an FG-GAP protein has in increasing order of preference 50%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 46, provided that the homologous protein comprises a signal peptide sequence, one or more FG-GAP domains, and a transmembrane domain in the C-terminal half of the protein, and preferably also one or more of the conserved motifs 1, 2 or 3. The overall sequence identity is determined using a global alignment algorithm, such as the Needleman Wunsch algorithm in the program GAP (GCG Wisconsin Package, Accelrys), preferably with default parameters and full-length protein sequences.

The various structural domains in an FG-GAP protein may be identified using specialised databases e.g. SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315318), Prosite (Bucher and Balroch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searis D., Eds., pp 53-61, AAAIPress, Menlo Park; Hulo et al., Nucl. Acids. Res. 32:D134-D137, (2004),) or Pfam (Bateman et al., Nucleic Acids Research 30(1):276-280 (2002)).

Methods for the search and identification of FG-GAP homologues would be well within the realm of persons skilled in the art. Such methods comprise comparison of the sequences represented by SEQ ID NO: 45 or 46, in a computer readable format, with sequences that are available in public databases such as MIPS, GenBank or EMBL Nucleotide Sequence Database, using algorithms well known in the art for the alignment or comparison of sequences, such as GAP (Needleman and Wunsch, J. Mol. Biol. 48; 443-453 (1970)), BESTFIT (using the local homology algorithm of Smith and Waterman (Advances in Applied Mathematics 2; 482-489 (1981))), BLAST (Altschul, S. F., Gish, W., Miller, W., Myers, E. W. & Lipman, D. J., J. Mol. Biol. 215:403-410 (1990)), FASTA and TFASTA (W. R. Pearson and D. J. Lipman Proc. Natl. Acad. Sci. USA 85:2444-2448 (1988)). The software for performing BLAST analysis is publicly available through the National Centre for Biotechnology Information (NCBI).

Examples of proteins falling under the definition of "FG-GAP polypeptide or a homologue thereof" include an *Arabidopsis* protein (SEQ ID NO: 55) and two rice proteins (SEQ ID NO: 57 and 59). The presence of FG-GAP proteins has also been demonstrated in other plant species of the Magnoliophyta, including *Titicum aestivum, Zea mays, Solanum tuberosum, Aquilegia* sp., *Brassica napus, Citrus sinensis, Asparagus officinalis, Populus* sp., *Euphorbia esula* and also in other plant taxa such as ferns (*Ceratoptedis richardii*) or in *Welwitschia mirabilis*. A non-limiting list of examples of ESTs encoding FG-GAP proteins is given in Table 8:

TABLE 8

| Species | GenBank accession | SEQ ID NO: |
|---|---|---|
| Triticum aestivum | CK207217 | 16 |
| Zea mays | AY111316 | 17 |
| Solanum tuberosum | BG598275 | 18 |
| Aquilegia sp. | DT735817 | 19 |
| Brassica napus | CX192752 | 20 |
| Citrus sinensis | CX674859 | 21 |
| Asparagus officinalis | CV288972 | 22 |
| Populus sp. | CN520999 | 23 |
| Populus sp. | CX176799 | 24 |
| Euphorbia esula | DV130386 | 25 |
| Ceratopteris richardii | CV736049 | 26 |
| Welwitschia mirabilis | DT601669 | 27 |

The proteins encoded by the genes from which these EST's are derived are also useful for practising the methods of the present invention and fall within the scope of this invention. A person skilled in the art would be able to isolate the full length coding sequence of these genes using standard methods.

The invention furthermore provides an isolated FG-GAP protein selected from the group consisting of:
(a) a protein encoded by the nucleic acid of SEQ ID NO: 72;
(b) a protein comprising a signal sequence, one or more FG-GAP domains and a transmembrane domain located in the C-terminal half of the protein, wherein said protein comprises at least one of SEQ ID NO: 73 to SEQ ID NO: 72;
(c) an active fragment of an amino acid sequence as defined in (a) or (b), which active fragment comprises a signal sequence, one or more FG-GAP domains and a transmembrane domain located in the C-terminal half of the protein.

It is to be understood that the term "FG-GAP polypeptide or a homologue thereof" is not to be limited to the sequence represented by SEQ ID NO: 46 or to the homologues listed as SEQ ID NO: 55, 57 and 59, but that any polypeptide meeting the criteria of comprising a signal peptide, one or more FG-GAP domains and a transmembrane domain located in the C-terminal half of the protein, and preferably also one or more of the conserved motifs of SEQ ID NO: 50 to 52; or having at least 50% sequence identity to the sequence of SEQ ID NO: 46, may be suitable for use in the methods of the Invention.

Plant FG-GAP proteins play a role during pollen development (Paxson-Sowders et al. 2001). In dex1 mutant plants, primexine deposition is delayed and significantly reduced. The normal rippling of the plasma membrane and production of spacers observed in wild-type plants is also absent in the mutant. FG-GAP proteins are able to complement this mutation and to restore the normal phenotype.

Alternatively, the activity of an FG-GAP protein or homologue thereof may be assayed by expressing the FG-GAP protein or homologue thereof under control of a constitutive promoter in *Oryza sativa*, which results in plants with increased aboveground biomass and/or increased seed yield compared to corresponding wild type plants. This increase in seed yield may be measured in several ways, for example as an increase of total seed weight, number of filled seeds or total number of seeds.

An FG-GAP protein or homologue thereof is encoded by an FG-GAP nucleic acid/gene. Therefore the term "FG-GAP nucleic acid/gene" as defined herein is any nucleic acid/gene encoding an FG-GAP protein or a homologue thereof as defined above.

Examples of FG-GAp nucleic acids include but are not limited to those represented by any one of SEQ ID NO: 45, SEQ ID NO: 54, SEQ ID NO: 56 or SEQ ID NO: 58. Examples of partial FG-GAP nucleic acids are listed in Table 8.

The invention also provides an isolated nucleic acid encoding an FG-GAP protein, selected from the group consisting of:
(i) the nucleic acid as represented in SEQ ID NO: 72;
(ii) a nucleic acid encoding a protein as defined in (a) to (c) above;
(iii) a nucleic acid sequence capable of hybridising (preferably under stringent conditions) with a nucleic acid sequence of (i) or (ii) above, which hybridising sequence preferably encodes a protein comprising a signal peptide, one or more FG-GAP domains and a transmembrane domain located in the C-terminal half of the protein;
(iv) a nucleic acid which is an allelic variant to the nucleic acid sequences according to (i) to (iii);
(v) a nucleic acid which is an alternative splice variant to the nucleic acid sequences according to (i) to (iii);
(vi) a portion of a nucleic acid sequence according to any of (i) to (v) above, which portion preferably encodes a protein comprising a signal peptide, one or more FG-GAP domains and a transmembrane domain located in the C-terminal half of the protein.

FG-GAP nucleic acids/genes and variants thereof may be suitable in practising the methods of the invention. Variant FG-GAP nucleic acid/genes include portions of an FG-GAP nucleic acid/gene, allelic variants, splice variants and/or nucleic acids capable of hybridising with an FG-GAP nucleic acid/gene.

The term portion as defined herein refers to a piece of DNA encoding a polypeptide comprising a signal peptide, one or more FG-GAP domains and a transmembrane domain located in the C-terminal half of the protein, and preferably also one or more of the conserved motifs of SEQ ID NO: 50 to 52. Preferably, the portion comprises one or more of the conserved motifs defined above. A portion may be prepared, for example, by making one or more deletions to an FG-GAP nucleic acid. The portions may be used in isolated form or they may be fused to other coding (or non coding) sequences in order to, for example, produce a protein that combines several activities. When fused to other coding sequences, the resulting polypeptide produced upon translation may be bigger than that predicted for the FG-GAP fragment. Preferably, the portion is a portion of a nucleic acid as represented by any one of SEQ ID NO: 45, SEQ ID NO: 54, SEQ ID NO: 56, SEQ ID NO: 58 or SEQ ID NO: 72. The portion may also be a portion of the coding sequences from which the sequences of Table 8 are derived. Most preferably the portion of a nucleic acid is as represented by SEQ ID NO: 45.

Another variant of an FG-GAP nucleic acid/gene is a nucleic acid capable of hybridising under reduced stringency conditions, preferably under stringent conditions, with an FG-GAP nucleic acid/gene as hereinbefore defined, which hybridising sequence encodes a polypeptide comprising a signal peptide, one or more FG-GAP domains and a transmembrane domain located in the C-terminal half of the protein, and preferably also one or more of the conserved motifs of SEQ ID NO: 50 to 52.

Preferably, the hybridising sequence is one that is capable of hybridising to a nucleic acid as represented by SEQ ID NO: 45, SEQ ID NO: 54, SEQ ID NO: 56, SEQ ID NO: 58 or SEQ ID NO: 72, or to a portion of any of the aforementioned sequences, including the EST's listed in Table 8. Most preferably the hybridising sequence is capable of hybridising to SEQ ID NO: 45. The term "hybridisation" is as defined in the section headed "Definitions".

The FG-GAP nucleic add or variant thereof may be derived from any natural or artificial source. The nucleic acid/gene or variant thereof may be isolated from a microbial source, such as yeast or fungi, or from a plant, algal or animal (including human) source. This nucleic acid may be modified from its native form in composition and/or genomic environment through deliberate human manipulation. The nucleic acid is preferably of plant origin, whether from the same plant species (for example to the one in which it is to be introduced) or whether from a different plant species. The nucleic acid may be isolated from a dicotyledonous species, preferably from the family Brassicaceae, further preferably from *Arabidopsis thaliana*. More preferably, the FG-GAP nucleic acid is isolated from *Arabidopsis thaliana* and is represented by SEQ ID NO: 45, and the FG-GAP amino acid sequence is as represented by SEQ ID NO: 46.

The expression of a nucleic acid encoding an FG-GAP polypeptide or a homologue thereof may be modulated by introducing a genetic modification (preferably in the locus of an FG-GAP gene). The locus of a gene as defined herein is taken to mean a genomic region, which includes the gene of interest and 10 kb up- or down stream of the coding region.

The genetic modification may be introduced, for example, by any one (or more) of the following methods: T-DNA activation, TILLING, site-directed mutagenesis, transposon mutagenesis, directed evolution and homologous recombination or by introducing and expressing in a plant a nucleic acid encoding an FG-GAP polypeptide or a homologue thereof. These methods are defined in the section headed "Definitions". Following introduction of the genetic modification, there follows a step of selecting for modified expression of a nucleic acid encoding an FG-GAP polypeptide or a homologue thereof, which modification in expression gives plants having increased yield.

T-DNA activation, TILLING, site-directed mutagenesis, transposon mutagenesis and directed evolution are examples of technologies that enable the generation of novel alleles and FG-GAP variants.

A preferred method for introducing a genetic modification (which in this case need not be in the locus of an FG-GAP gene) is to introduce and express in a plant a nucleic acid encoding an FG-GAP polypeptide or a homologue thereof, as defined above. The nucleic acid to be introduced into a plant may be a full-length nucleic acid or may be a portion or a hybridising sequence as hereinbefore defined. Preferably, the plant in which the genetic modification is introduced is not a dex1 mutant plant, in which the DEX1 gene is not functional (Paxson-Sowders et al. 2001).

"Homologues" of a protein are defined in the section headed "Definitions". The FG-GAP polypeptide or homologue thereof may be a derivative, as defined in the "Definitions" section.

The FG-GAP polypeptide or homologue thereof may be encoded by an alternative splice variant of an FG-GAP nucleic acid/gene. The term "alternative splice variant" is as defined herein. Preferred are splice variants of the nucleic acid encoding a polypeptide comprising a signal peptide, one or more FG-GAP domains and a transmembrane domain located in the C-terminal half of the protein, and preferably also one or more of the conserved motifs of SEQ ID NO: 50 to 52. Further preferred are splice variants represented by SEQ ID NO: 45, SEQ ID NO: 54, SEQ ID NO: 56 or SEQ ID NO: 58, or a splice variant of the nucleic acid represented by SEQ ID NO: 72, or a splice variant of one of the genes from which the sequences in Table 8 are derived. Most preferred is the splice variant represented by SEQ ID NO: 45.

The homologue may also be encoded by an allelic variant of a nucleic acid encoding an FG-GAP polypeptide or a homologue thereof, preferably an allelic variant of a nucleic acid encoding a polypeptide comprising a signal peptide, one or more FG-GAP domains and a transmembrane domain located in the C-terminal half of the protein, and preferably also one or more of the conserved motifs of SEQ ID NO: 50 to 52. Further preferably, the allelic variant encoding the FG-GAP polypeptide is represented by any one of SEQ ID NO: 45, SEQ ID NO: 54, SEQ ID NO: 56 or SEQ ID NO: 58. Most preferably, the allelic variant encoding the FG-GAP polypeptide is as represented by SEQ ID NO: 45. Allelic variants are defined in the "Defintions" section.

According to a preferred aspect of the present invention, modulated expression of the FG-GAP nucleic acid or variant thereof is envisaged. Preferably, the modulated expression is overexpression. Methods for overexpression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of an FG-GAP nucleic acid or variant thereof. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene. Methods for reducing the expression of genes or gene products are also well documented in the art.

If polypeptide expression is desired, it is generally desirable to include a polyadenylation region at the 3'-end of a polynucleotide-coding region. The polyadenylation region may be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold, Buchman and Berg, Mol. Cell. biol. 8:4395-4405 (1988); Callis et al., Genes Dev. 1:1183-1200 (1987). Such intron enhancement of gene expression is typically greatest when placed near the 5' end of the transcription unit. Use of the maize introns Adh1-S intron 1, 2, and 6, the Bronze-1 intron are known in the art. See generally, The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention. Therefore, there is provided a gene construct comprising:
(i) an FG-GAP nucleic acid or variant thereof, as defined hereinabove;
(ii) one or more control sequences capable of driving expression of the nucleic acid sequence of (i); and optionally
(iii) a transcription termination sequence;
with the proviso that the gene construct is not a pPZP-type gene construct as described by Hajdukiewicz et al. (Plant Mol. Biol. 25, 989-994) and Paxson-Sowders (2001).

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells.

Plants are transformed with a vector comprising the sequence of interest (i.e., a nucleic acid encoding an FG-GAP polypeptide or homologue thereof). The sequence of interest is operably linked to one or more control sequences (at least to a promoter). The terms "regulatory element", "control sequence" and "promoter" are all used interchangeably herein and are defined in the section headed "Definitions".

Advantageously, any type of promoter may be used to drive expression of the nucleic acid sequence. Preferably, the FG-GAP nucleic acid or functional variant thereof is operably linked to a constitutive promoter. The term "constitutive" is as defined herein. Preferably, the constitutive promoter capable of preferentially expressing the nucleic acid throughout the plant has a comparable expression profile to a GOS2 promoter. More preferably, the constitutive promoter has the same expression profile as the rice GOS2 promoter, most preferably, the promoter capable of preferentially expressing the nucleic acid throughout the plant is the GOS2 promoter from rice (nucleotides 1 to 2193 of the sequence represented in SEQ ID NO: 49). It should be clear that the applicability of the present invention is not restricted to the FG-GAP nucleic acid represented by SEQ ID NO: 45, nor is the applicability of the invention restricted to expression of an FG-GAP nucleic acid when driven by a GOS2 promoter. Examples of other constitutive promoters that may also be used to drive expression of an FG-GAP nucleic acid are shown in Table 3 in the "Definition" section.

Optionally, one or more terminator sequences may also be used in the construct introduced into a plant. The term "terminator" being defined in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene as defined in the "Definitions" section herein.

The present invention also encompasses plants obtainable by the methods according to the present invention. The present invention therefore provides plants obtainable by the method according to the present invention, which plants have introduced therein an FG-GAP nucleic acid or variant thereof, as defined above.

The invention also provides a method for the production of transgenic plants having increased yield, comprising introduction and expression in a plant of an FG-GAP nucleic acid or a variant thereof as defined above.

More specifically, the present invention provides a method for the production of transgenic plants having increased yield, which method comprises:
 (i) introducing and expressing in a plant or plant cell an FG-GAP nucleic acid or variant thereof; and
 (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation.

The term "transformation" is as defined in the "Definitions" section.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention. The invention also includes host cells containing an isolated FG-GAP nucleic acid or variant thereof. Preferred host cells according to the invention are plant cells. The invention also extends to harvestable parts of a plant such as, but not limited to seeds, leaves, fruits, flowers, stem cultures, rhizomes, tubers and bulbs. The invention furthermore relates to products derived, preferably directly derived, from a harvestable part of such a plant, such as dry pellets or powders, oil, fat and fatty acids, starch and proteins.

The present invention also encompasses use of FG-GAP nucleic acids or variants thereof and use of FG-GAP polypeptides or homologues thereof.

One such use relates to improving the growth characteristics of plants, in particular in improving yield, especially seed yield. The seed yield may include one or more of the following: increased total weight of seeds, increased number of filled seeds and increased total number of seeds.

FG-GAP nucleic acids or variants thereof, or FG-GAP polypeptides or homologues thereof may find use in breeding programmes in which a DNA marker is identified which may be genetically linked to an FG-GAP gene or variant thereof. The FG-GAP nucleic acids/genes or variants thereof, or FG-GAP polypeptides or homologues thereof may be used to define a molecular marker. This DNA or protein marker may then be used in breeding programmes to select plants having increased yield. The FG-GAP gene or variant thereof may, for example, be a nucleic acid as represented by any one of SEQ ID NO: 45, SEQ ID NO: 54, SEQ ID NO: 56, SEQ ID NO: 58, and SEQ ID NO: 72, or genes from which the sequences listed in Table 8 were derived.

Allelic variants of an FG-GAP nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question, for example, different allelic variants of any one of SEQ ID NO: 45, SEQ ID NO: 54, SEQ ID NO: 56, SEQ ID NO: 58, and SEQ ID NO: 72, or of one of the coding sequences from which the sequences listed in Table 8 were derived. Growth performance may be monitored in a greenhouse or in the field. Further optional steps include crossing plants, in which the superior allelic variant was identified, with another plant. This could be used, for example, to make a combination of interesting phenotypic features.

An FG-GAP nucleic acid or variant thereof may also be used as probes for genetically and physically mapping the genes that they are a part of, and as markers for traits linked to those genes. Such information may be useful in plant breeding in order to develop lines with desired phenotypes. Such use of FG-GAP nucleic acids or variants thereof requires only a nucleic acid sequence of at least 15 nucleotides in length. The FG-GAP nucleic acids or variants thereof may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the FG-GAP nucleic acids or variants thereof. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the FG-GAP nucleic acid or variant thereof in the genetic map previously obtained using this population (Botstein et al. (1980) Am. J. Hum. Genet. 32: 314-331).

The production and use of plant gene-derived probes for use in genetic mapping is described in Bernatzky and Tanksley (Plant Mol. Biol. Reporter 4: 37-41, 1986). Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridization (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al., (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-4807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having increased yield, as described hereinbefore. These advantageous growth characteristics may also be combined with other economically advantageous traits, such as further yield-enhancing traits, tolerance to various stresses, traits modifying various architectural features and/or biochemical and/or physiological features.

Detailed Description CYP90B

The term "CYP90B polypeptide or homologue thereof" as defined herein refers to a polypeptide comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position.

Furthermore, the CYP90B polypeptide or homologue thereof may additionally comprise (i) a sequence with more than 50% identity to SEQ ID NO: 78 and (ii) steroid 22-alpha hydroxylase enzymatic activity.

Examples of a CYP90B polypeptide as defined hereinabove are given in Table 9a herein.

A CYP90B polypeptide or homologue thereof is encoded by a CYP90B nucleic acid/gene. Therefore the term "CYP90B nucleic acid/gene" as defined herein is any nucleic acid/gene encoding a CYP90B polypeptide or a homologue thereof as defined hereinabove.

The various structural domains found in the CYP superfamily of proteins, including in CYP90B polypeptides of the present invention, are well known in the art and may be identified using general databases e.g. SMART (Schultz et al. (1998) Proc. Natl. Acad. Sci. USA 95, 5857-5864; Letunic et al. (2002) Nucleic Acids Res 30, 242-244; smart.embl-heidelberg.de/), InterPro (Mulder et al., (2003) Nucl. Acids. Res. 31, 315-318; at webpage ebi.ac.uk/interpro/), Prosite (Bucher and Bairoch (1994), A generalized profile syntax for biomolecular sequences motifs and its function in automatic sequence interpretation, in ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004), at webpage expasy.org/prosite/) or Pfam (Bateman et al., Nucleic Acids Research 30(1):276-280 (2002), at webpage sanger.ac.uk/Software/Pfam/).

Specialized databases may also be searched at arabidopsis-P450.biotec.uiuc.edu/cgi-bin/p450.pl for *Arabidopsis*, or more generally on the CYP Homepage drnelson.utmem.edu/CytochromeP450.html. Typical structural domains found in CYP may be the four A to D domains as originally described by Kalb & Loper ((1988) Proc Natl Acad Sci 85: 7221-7225). The A domain (also called helix I) comprises the consensus sequence Ala/Gly-Gly-X-Asp/Glu-Thr-Thr/Ser (SEQ ID NO: 291), and is proposed to bind dioxygen. The B domain is the steroid binding domain. The D domain corresponds to the heme binding domain and comprises the most characteristic CYP amino acid consensus sequence (Phe-X-X-Gly-X-Arg-X-Cys-X-Gly) (SEQ ID NO: 292) (FIGS. 10 and 13).

The presence of consensus sequences may be identified using methods for the alignment of sequences for comparison as described hereinabove. In some instances, the default parameters may be adjusted to modify the stringency of the search. For example using BLAST, the statistical significance threshold (called "expect" value) for reporting matches against database sequences may be increased to show less stringent matches. This way, short nearly exact matches may be identified. The consensus sequence Phe-Ala-Gly-His-Glu-Thr-Ser-Ser (SEQ ID NO: 290) within the A domain of the CYP90B polypeptide (comprising the consensus sequence Ala/Gly-Gly-X-Asp/Glu-Thr-Thr/Ser (SEQ ID NO: 293) as defined hereinabove) as defined herein may be identified in this manner, as a person skilled in the art would be well aware of.

Another domain identified in CYP P450 proteins, and in particular in the CYP90B polypeptide of the invention, may be the anchor domain at the N terminus of the protein for membrane-targeting, rich in hydrophobic residues such as Leu, Ile, Val, Phe and Ala. The N-terminal anchor domain is typically between 20 to 40 amino acids long, but may be shorter (down to 10 amino acids) or longer (up to 100 amino acids). The N-terminal anchor domain is separated from the rest of the protein (globular domain) by a transition domain comprising a cluster of basic residues (at least two, either Lys or Arg, called the halt-transfer signal) preceding a proline cluster that forms a hinge between the abovementioned anchor domain and the globular domain of the protein. A typical consensus sequence for the transition domain is Lys/Arg-Lys/Arg-(X)3-9-Pro-Pro-Gly (SEQ ID NO: 295) (FIGS. 10 and 13). Such a consensus sequence may be identified as mentioned hereinabove.

The presence of an N-terminal hydrophobic anchor domain may readily be identified. Primary amino acid composition (in %) to determine if a polypeptide domain is rich in specific amino acids may be calculated using software programs from the ExPASy server, in particular the ProtParam tool (Gasteiger E et at (2003) ExPASy: the proteomics server for in-depth protein knowledge and analysis. Nucleic Acids Res 31:3784-3788). The composition of the protein of interest may then be compared to the average amino acid composition (in %) in the Swiss-Prot Protein Sequence data bank. Within this databank, the addition of the averages of Leu (L), Ile (1), Val (V), Phe (F) and Ala (A) is of 34.04%. As an example, the N-terminal hydrophobic anchor domain of SEQ ID NO: 78 contains 62.5% of the same hydrophobic residues. As defined herein, a N-terminal hydrophobic anchor domain has a hydrophobic amino acid content (in % terms) above that found in the average amino acid composition (in % terms) of the proteins in the Swiss-Prot Protein Sequence database.

Special softwares such as ProtScale (Gasteiger et al. (2005) Protein Identification and Analysis Tools on the ExPASy Server. In John M. Walker, ed: The Proteomics Protocols Handbook, Humana Press pp. 571-607) compute and represent the profile produced by any amino acid scale on a selected protein. An amino acid scale is defined by a numerical value assigned to each type of amino acid. The most frequently used scales are the hydrophobicity or hydrophilicity scales and the secondary structure conformational parameters scales. One of the most frequently used hydrophobicity amino acid scale has been produced by Kyte & Doolittle ((1982) J. Mol. Biol. 157:105-132), in which hydrophobic amino acids have been attributed a positive number, and hydrophilic amino acids a negative number. For example, the ProtScale output profile for hydrophobicity of the CYP90B polypeptide of the invention clearly shows that approximately the first N-terminal 34 amino acids represent a hydrophobic domain, as these are located above the zero delimiting line (FIG. 12). This region corresponds to the N-terminal anchor domain. A person skilled in the art would be well aware of such analyses.

CYP90B polypeptides or homologues thereof may readily be identified using routine techniques well known in the art, such as by sequence alignment. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the alignment of two complete sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information. Homologues of CYP90B comprising comprising a sequence with more than 50% identity to SEQ ID NO: 78 may readily be identified using, for example, the ClustalW multiple sequence alignment algorithm (version 1.83) available at http://clustalw.genomejp/sit-bin/nph-ClustalW, with the default pairwise alignment parameters, and a scoring method in percentage. Minor manual editing may be performed to optimise alignment between conserved motifs, as would be apparent to a person skilled in the art.

Examples of CYP90B polypeptides or homologues thereof (encoded by polynucleotide sequence accession number in parenthesis) are given in Table 9a. Table 9b provides for partial CYP90B sequences encoding partial CYP90B open reading frames (ORF).

TABLE 9a

Examples of CYP90B homologues

| Name | NCBI or TIGR nucleotide accession number | Nucleotide SEQ ID NO | Translated polypeptide SEQ ID NO | Insert status | Source |
| --- | --- | --- | --- | --- | --- |
| Orysa_CYP90B | AB206579.1 | 77 | 78 | Full length ORF | Oryza sativa |
| Arath_CYP90B1 | NM_114926.2 | 79 | 80 | Full length ORF | Arabidopsis thaliana |
| Sacof_CYP90B** | CA092707.1 CF574030.1 CA217329.1 | 81 | 82 | Full length ORF | Saccharum officinarum |
| Allce_CYP90B | TC2113 | 83 | 84 | Full length ORF | Allium cepa |
| Zinel_CYP90B | AB231155 | 85 | 86 | Full length ORF | Zinnia elegans |
| Medtr_CYP90B* | AC147964.10 | 87 | 88 | Full length ORF | Medicago truncatula |
| Poptr_CYP90B''** | CK090847.1 CV280598.1 DT503533.1 | 89 | 90 | Full length ORF | Populus trichocarpa |

TABLE 9b

Examples of CYP90B with a partial open reading frame (ORF)

| Name | NCBI or TIGR nucleotide accession number | Nucleotide SEQ ID NO | Translated polypeptide SEQ ID NO | Insert status | Source |
| --- | --- | --- | --- | --- | --- |
| Aqufo_CYP90B** | DR940523.1 DR940522.1 | 91 | 92 | Partial ORF | Aquilegia formosa x |

TABLE 9b-continued

Examples of CYP90B with a partial open reading frame (ORF)

| Name | NCBI or TIGR nucleotide accession number | Nucleotide SEQ ID NO | Translated polypeptide SEQ ID NO | Insert status | Source |
|---|---|---|---|---|---|
| | | | | | *Aquilegia pubescens* |
| Triae_CYP90B 5' end | BQ620306.1 | 93 | 94 | Partial ORF | *Triticum aestivum* |
| Triae_CYP90B 3' end** | BQ619714.1 CA715360.1 | 95 | 96 | Partial ORF | *Triticum aestivum* |
| Eupes_CYP90B | DV141872.1 | 97 | 98 | Partial ORF | *Euphorbia esula* |
| Goshi_CYP90B 5' end** | CO125422 DT568185.1 | 99 | 100 | Partial ORF | *Gossypium hirsutum* |
| Lyces_CYP90B 5' end** | BF050501 AW221826.1 BM409833 | 101 | 102 | Partial ORF | *Lycopersicon esculentum* |
| Soltu_CYP90B 5' end** | BQ045917 BQ114367 | 103 | 104 | Partial ORF | *Solanum tuberosum* |
| Soltu_CYP90B 3' end** | BQ114368 | 105 | 106 | Partial ORF | *Solanum tuberosum* |

*Manual splicing from genomic clone
**Contig compiled from several EST accessions (main ones shown); EST sequencing quality being usually lower, a few nucleic acid substitutions may be expected.

It is to be understood that sequences falling under the definition of "CYP90B polypeptide or homologue thereof" are not to be limited to the sequences represented by SEQ ID NO: 78, SEQ ID NO: 80, SEQ ID NO: 82, SEQ ID NO: 84, SEQ ID NO: 86, SEQ ID NO: 88 or SEQ ID NO: 90, but that any polypeptide comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position may be suitable for use in performance of the invention.

The sequences falling under the definition of "CYP90B polypeptide or homologue thereof" may additionally comprise (i) a sequence with more than 50% identity to SEQ ID NO: 78 and (ii) steroid 22-alpha hydroxylase enzymatic activity.

CYP90B polypeptides or homologues thereof have 22-alpha hydroxylase enzymatic activity, which may be determined by complementation testing using plants having a mutation in DWF4. Such mutant plants are described in *Arabidopsis* (dwf4 mutant) by Choe et al. ((1998) Plant Cell 10:231-243) and in rice (Tos2091 mutant) by Tanaka et al (US2004/0060079). The size of these mutant plants is several fold smaller than that of their corresponding wild types, i.e., the mutant plants are super-dwarfed. The isolated polypeptide is placed under the control of a promoter capable of expressing this polypeptide in plants, in a recombinant DNA vector suitable for plant transformation. The mutant plants are then transformed with this vector, using techniques that are well known in the art. If the transformed plants no longer display the super-dwarfed phenotype that is indicative that the isolated polypeptide is capable displaying 22-alpha hydroxylase enzymatic activity. Such a polypeptide may be suitable for use in performance of the methods of the invention.

Examples of CYP90B nucleic acids include but are not limited to those represented by any one of SEQ ID NO: 77, SEQ ID NO: 79, SEQ ID NO: 81, SEQ ID NO: 83, SEQ ID NO: 85, SEQ ID NO: 87 or SEQ ID NO: 0.89. CYP90B nucleic acids/genes and variants thereof may be suitable in practising the methods of the invention. Variants of CYP90B nucleic acid/genes include portions of a CYP90B nucleic acid/gene and/or nucleic acids capable of hybridising with a CYP90B nucleic acid/gene.

The term portion as defined herein refers to a piece of DNA encoding a polypeptide comprising the following: (a) CYP P450 domains A to D; (b) an N-terminal hydrophobic anchor domain; (c) a transition domain; and (d) within the A domain, the consensus sequence Phe-Ala-Gly-His-Glu-Thr-Ser-Ser, allowing for one amino acid change at any position. A portion may be prepared, for example, by making one or more deletions to a CYP90B nucleic acid. The portions may be used in isolated form or they may be fused to other coding (or non coding) sequences in order to, for example, produce a protein that combines several activities. When fused to other coding sequences, the resulting polypeptide produced upon translation may be bigger than that predicted for the CYP90B portion. Preferably, the portion is a portion of a nucleic acid as represented by any one of SEQ ID NO: 77, SEQ ID NO: 79, SEQ ID NO: 81, SEQ ID NO: 83, SEQ ID NO: 85, SEQ ID NO: 87 and SEQ ID NO: 89. Most preferably the portion is a portion of a nucleic acid as represented by SEQ ID NO: 77. Another variant of a CYP90B nucleic acid/gene is a nucleic acid capable of hybridising under reduced stringency conditions, preferably under stringent conditions, with a CYP90B nucleic acid/gene as hereinbefore defined, which hybridising sequence encodes a polypeptide comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser, allowing for one amino acid change at any position. Preferably, the hybridising sequence is one that is capable of hybridising to a nucleic acid as represented by any one of SEQ ID NO: 77, SEQ ID NO: 79, SEQ ID NO: 81, SEQ ID NO: 83, SEQ ID NO: 85, SEQ ID NO: 87 and SEQ ID NO: 89, or to a portion of any of the aforementioned sequences as defined hereinabove. Most preferably the hybridising sequence is one that is capable of hybridising to a nucleic acid as represented by SEQ ID NO: 77. The term "hybridisation" is as defined herein in the "Definitions" section.

The CYP90B nucleic acid or variant thereof may be derived from any natural or artificial source. The nucleic acid/gene or variant thereof may be isolated from a microbial source, such as yeast or fungi, or from a plant, algae or animal (including human) source. This nucleic acid may be modified from its native form in composition and/or genomic environment through deliberate human manipulation. The nucleic acid is preferably of plant origin, whether from the same plant species (for example to the one in which it is to be introduced) or whether from a different plant species. The nucleic acid may be isolated from a monocotyledonous species, preferably from the family Poaceae, further preferably from Oryza genus, most preferably from *Oryza* saliva. More preferably, the CYP90B nucleic acid isolated from *Oryza sativa* is represented by SEQ ID NO: 77 and the CYP90B amino acid sequence is as represented by SEQ ID NO: 78.

The invention furthermore provides an isolated CYP90B protein selected from the group consisting of:

a protein encoded by the nucleic acid of SEQ ID NO: 117;

a protein comprising comprising the following: (i) CYP domains A to D; (ii) an N-terminal hydrophobic anchor domain; (iii) a transition domain; and (iv) within the A domain, the consensus sequence Phe-Ala-Gly-His-Glu-Thr-Ser-Ser (SEQ ID NO: 290), allowing for one amino acid change at any position, and having in increasing order of preference at least 85%, 86%, 87%, 88%, 89%, 90%, 91%, 92%, 93%, 94%, 95%, 96%, 97%, 98%, 99% identity to the amino acid sequence of SEQ ID NO: 118.

The invention also provides an isolated nucleic acid encoding a CYP90B protein, selected from the group consisting of:

a nucleic acid as represented by SEQ ID NO: 117;

a nucleic acid encoding a protein as defined in (a) and (b) above;

a nucleic acid having in increasing order of preference at least 82%, 83%, 84%, 85%, 86%, 87%, 88%, 89%, 90%, 91%, 92%, 93%, 94%, 95%, 96%, 97%, 98%, 99% or more identity to the nucleic acid represented by SEQ ID NO: 117;

a nucleic acid sequence capable of hybridising under stringent conditions with a nucleic acid sequence of (i) to (iii) above, which hybridising sequence encodes a protein comprising (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position, and having in increasing order of preference at least 85%, 86%, 87%, 88%, 89%, 90%, 91%, 92%, 93%, 94%, 95%, 96%, 97%, 98%, 99% or more to the amino acid sequence of SEQ ID NO: 118;

a nucleic acid which is an allelic variant or a splice variant of the nucleic acid sequences according to (i) to (iv);

a portion of a nucleic acid sequence according to any of (i) to (v) above, which portion encodes a protein comprising: (i) CYP domains A to D; (ii) an N-terminal hydrophobic anchor domain; (iii) a transition domain; and (iv) within the A domain, the consensus sequence Phe-Ala-Gly-His-Glu-Thr-Ser-Ser (SEQ ID NO: 290), allowing for one amino acid change at any position, and having in increasing order of preference at least 85%, 86%, 87%, 88%, 89%, 90%, 91%, 92%, 93%, 94%, 95%, 96%, 97%, 98%, 99% to the amino acid sequence of SEQ ID NO: 118.

Furthermore, the CYP90B polypeptide or homologue thereof may additionally comprise (i) a sequence with more than 50% identity to SEQ ID NO: 78 and (ii) steroid 22-alpha hydroxylase enzymatic activity.

The expression of a nucleic acid encoding a CYP90B polypeptide or a homologue thereof may be increased non-constitutive by introducing a genetic modification (preferably in the locus of a CYP90B gene). The locus of a gene as defined herein is taken to mean a genomic region, which includes the gene of interest and 10 kb up- or downstream of the coding region.

The genetic modification may be introduced, for example, by any one (or more) of the following methods: T-DNA activation, TILLING, site-directed mutagenesis, directed evolution and homologous recombination or by introducing and expressing in a plant a nucleic acid encoding a CYP90B polypeptide or a homologue thereof. The aforementioned methods are defined in the "Definitions" section. Following introduction of the genetic modification, there follows a step of selecting for increased non-constitutive expression of a nucleic acid encoding a CYP90B polypeptide or a homologue thereof, which increase in non-constitutive expression gives plants having increased yield.

T-DNA activation, TILLING, site-directed mutagenesis and directed evolution are examples of technologies that enable the generation of novel alleles and CYP90B variants.

A preferred method for introducing a genetic modification (which in this case need not be in the locus of a CYP90B gene) is to introduce and express in a plant a nucleic acid encoding a CYP90B polypeptide or a homologue thereof. A CYP90B polypeptide or a homologue thereof is defined as polypeptide comprising comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position. The nucleic acid to be introduced into a plant may be a full-length nucleic acid or may be a portion or a hybridising sequence as hereinbefore defined. Furthermore, the nucleic acid encoding a CYP90B polypeptide or a homologue thereof may additionally comprise (i) a sequence with more than 50% identity to SEQ ID NO: 78 and (ii) steroid 22-alpha hydroxylase enzymatic activity.

"Homologues" of a protein are defined herein in the "Definitions" section. The CYP90B polypeptide or homologue thereof may be a derivative, as defined in the "Definitions" section.

The CYP90B polypeptide or homologue thereof may be encoded by an alternative splice variant of a CYP90B nucleic acid/gene. The term "alternative splice variant" is defined in the "Definitions" section. Preferred splice variants are splice variants of the nucleic acid encoding a polypeptide comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position. Additionally, the CYP90B polypeptide or a homologue thereof may additionally comprise (i) a sequence with more than 50% identity to SEQ ID NO: 78 and (ii) steroid 22-alpha hydroxylase enzymatic activity. Further preferred are splice variants of nucleic acid sequences represented by SEQ ID NO: 77, SEQ ID NO: 79, SEQ ID NO: 81, SEQ ID NO: 83, SEQ ID NO: 85, SEQ ID NO: 87 and SEQ ID NO: 89. Most preferred is a splice variant of a nucleic acid sequence as represented by SEQ ID NO: 77.

The homologue may also be encoded by an allelic variant of a nucleic acid encoding a CYP90B polypeptide or a homologue thereof, preferably an allelic variant of the nucleic acid encoding a polypeptide comprising the following: (a) CYP domains A to D; (b) an N-terminal hydrophobic anchor domain; (c) a transition domain; and (d) within the A domain, the consensus sequence Phe-Ala-Gly-His-Glu-Thr-Ser-Ser (SEQ ID NO: 290), allowing for one amino acid change at any position. Additionally, the CYP90B polypeptide or a homologue thereof may additionally comprise (i) a sequence with more than 50% identity to SEQ ID NO: 78 and (ii) steroid 22-alpha hydroxylase enzymatic activity. Further preferred are allelic variants of nucleic acid sequences represented by SEQ ID NO: 77, SEQ ID NO: 79, SEQ ID NO: 81, SEQ ID NO: 83, SEQ ID NO: 85, SEQ ID NO: 87 and SEQ ID NO: 89. Most preferred is an allelic variant of a nucleic acid sequence as represented by SEQ ID NO: 77. Allelic variants are also defined in the "Definitions" section.

According to a preferred aspect of the present invention, increased non-constitutive expression of the CYP90B nucleic acid or variant thereof is envisaged. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a CYP90B nucleic acid or variant thereof. For example, endogenous promoters may be altered in vivo by mutation, deletion, and/or substitution (see, Kmiec, U.S. Pat. No. 5,565, 350; Zarling et al., PCT/US93/03868), or isolated promoters may be introduced into a plant cell in the proper orientation and distance from a gene of the present invention so as to control the expression of the gene. Methods for reducing the expression of genes or gene products are well documented in the art.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. See generally, The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention.

Therefore, there is provided a gene construct comprising:
(i) A CYP90B nucleic acid or variant thereof, as defined hereinabove;
(ii) One or more control sequences capable of driving non-constitutive expression of the nucleic acid sequence of (i); and optionally
(iii) A transcription termination sequence.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells. The invention therefore provides use of a gene construct as defined hereinabove in the methods of the invention.

Plants are transformed with a vector comprising the sequence of interest (i.e., a nucleic acid encoding a CYP90B polypeptide or homologue thereof). The sequence of interest is operably linked to one or more control sequences (at least to a promoter). The terms "regulatory element", "control sequence" and "promoter" are all used interchangeably herein and are defined in the "Definitions" section.

Advantageously, any non-constitutive type of promoter may be used to drive expression of the nucleic acid sequence. The non-constitutive promoter may be an inducible promoter, i.e. having induced or increased transcription initiation in response to a developmental, chemical, environmental or physical stimulus. An example of an inducible promoter being a stress-inducible promoter, i.e. a promoter activated when a plant is exposed to various stress conditions. The non-constitutive promoter may be a tissue-preferred promoter, i.e. one that is capable of preferentially initiating transcription in certain tissues, such as the leaves, roots, seed tissue etc. Promoters able to initiate transcription in certain tissues only are referred to herein as "tissue-specific".

According to the methods of the invention, the CYP90B nucleic acid or variant thereof is operably linked to a non-constitutive promoter. A non-constitutive promoter is transcriptionally active only during some phases of plant growth and development and is not ubiquitously expressed. The non-constitutive promoter may be for example a seed-specific promoter, or a root-specific promoter. The seed specific promoter may be an endosperm-specific and/or embryo/aleurone-specific promoter, i.e., transcriptionally active in the seed endosperm and/or seed embryo and aleurone, respectively. The endosperm-specific promoter is preferably a seed-storage protein promoter, further preferably the endosperm-specific promoter is a prolamin promoter, more preferably the endosperm-specific promoter is a rice RP6 prolamin promoter, yet more preferably the endosperm-specific promoter is represented by a nucleic acid sequence substantially similar to SEQ ID NO: 109, most preferably the endosperm-specific promoter is as represented by SEQ ID NO: 109. The embryo/aleurone-specific promoter is preferably a seed-storage protein promoter, further preferably the embryo/aleurone-specific promoter is an oleosin promoter, more preferably the embryo/aleurone-specific promoter is a rice oleosin 18 kDa promoter, yet more preferably the embryo/aleurone-specific promoter is represented by a nucleic acid sequence substantially similar to SEQ ID NO: 110, most preferably the embryo/aleurone-specific promoter is as represented by SEQ ID NO: 110. The root-specific promoter is preferably an Rcc3 promoter, the root-specific promoter is preferably a rice Rcc3 promoter (Xu et al. (1995) Plant Mol Biol 27(2):23748).

It should be clear that the applicability of the present invention is not restricted to the CYP90B nucleic acid represented by SEQ ID NO: 77, nor is the applicability of the invention restricted to expression of a CYP90B nucleic acid when driven by a RP6 prolamin or 18 kDa oleosin promoter. Examples of other non-constitutive promoters that may also be used to perform the methods of the invention are shown in Table 4 in the "Definitions" section.

In contrast to the above-described promoters, a constitutive promoter is transcriptionally active during most phases of plant growth and development and is substantially ubiquitously expressed in the plant. Such constitutive promoters are to be excluded for performance of the methods of the invention. Examples of such promoters may also be found in the "Definitions" section (see Table 3).

Optionally, one or more terminator sequences may also be used in the construct introduced into a plant. The term "terminator" is defined in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosrmid molecule). Preferred origins of replication include, but are not limited to, the f1-ori and colE1.

The genetic construct may optionally comprise a selectable marker gene as defined in the "Definitions" section.

In a preferred embodiment, there is provided a gene construct comprising:
(i) A CYP90B nucleic acid or variant thereof, as defined hereinabove;
(ii) A promoter capable of driving non-constitutive expression of the nucleic add sequence of (i); and optionally
(iii) A transcription termination sequence.

The non-constitutive promoter is preferably a seed-specific promoter. The seed specific promoter may be an endosperm-specific and/or embryo/aleurone-specific promoter, i.e., transcriptionally active in the seed endosperm and/or seed embryo and aleurone, respectively. The endosperm-specific promoter is preferably a seed-storage protein promoter, further preferably the endosperm-specific promoter is a prolamin promoter, more preferably the endosperm-specific promoter is a rice RP6 prolamin promoter, more preferably the endosperm-specific promoter is represented by a nucleic acid sequence substantially similar to SEQ ID NO: 109, most preferably the endosperm-specific promoter is as represented by SEQ ID NO: 109. The embryo/aleurone-specific promoter is preferably a seed-storage protein promoter, further preferably the embryo/aleurone-specific promoter is an oleosin promoter, more preferably the embryo/aleurone-specific promoter is a rice oleosin 18 kDa promoter, more preferably the embryo/aleurone-specific promoter is represented by a nucleic acid sequence substantially similar to SEQ ID NO: 110, most preferably the embryo/aleurone-specific promoter is as represented by SEQ ID NO: 110. The invention further provides use of a construct as defined hereinabove in the methods of the invention.

The present invention also encompasses plants obtainable by the methods according to the present invention. The present invention therefore provides plants, plant parts or plant cells thereof obtainable by the method according to the present invention, which plants or parts or cells thereof comprise a transgene CYP90B nucleic acid or variant thereof.

The invention also provides a method for the production of transgenic plants having increased yield relative to suitable control plants comprising introduction and non-constitutive expression in a plant of a CYP90B nucleic acid or a variant thereof.

More specifically, the present invention provides a method for the production of transgenic plants having increased yield which method comprises:
(i) introducing and expressing non-constitutively in a plant, plant part or plant cell a CYP90B nucleic acid or variant thereof; and
(ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation.

The term "transformation" is as defined in the "Definitions" section.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated CYP90B nucleic acid or variant thereof, non-constitutively expressed. Preferred host cells according to the invention are plant cells.

The invention also extends to harvestable parts of a plant such as, but not limited to seeds, leaves, fruits, flowers, stems, rhizomes, tubers and bulbs. The invention furthermore relates to products derived from a harvestable part of such a plant, such as dry pellets or powders, oil, fat and fatty acids, starch or proteins.

The present invention also encompasses use of CYP90B nucleic acids or variants thereof and use of CYP90B polypeptides or homologues thereof. Such uses relate to increasing plant yield as defined hereinabove in the methods of the invention.

CYP90B nucleic acids or variants thereof, or CYP90B polypeptides or homologues thereof may find use in breeding programmes in which a DNA marker is identified which may be genetically linked to a CYP90B gene or variant thereof. The CYP90B nucleic acids/genes or variants thereof, or CYP90B polypeptides or homologues thereof may be used to define a molecular marker. This DNA or protein marker may then be. used in breeding programmes to select plants having increased yield as defined hereinabove in the methods of the invention. The CYP90B gene or variant thereof may, for example, be a nucleic acid as represented by any one of SEQ ID NO: 77, SEQ ID NO: 79, SEQ ID NO: 81, SEQ ID NO: 83, SEQ ID NO: 85, SEQ ID NO: 87 and SEQ ID NO: 89.

Allelic variants of a CYP90B nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question, for example, different allelic variants of any one of SEQ ID NO: 77, SEQ ID NO: 79, SEQ ID NO: 81, SEQ ID NO: 83, SEQ ID NO: 85, SEQ ID NO: 87 and SEQ ID NO: 89. Growth performance may be monitored in a greenhouse or in the field. Further optional steps include crossing plants in which the superior allelic variant was identified with another plant. This could be used, for example, to make a combination of interesting phenotypic features.

A CYP90B nucleic acid or variant thereof may also be used as probes for genetically and physically mapping the genes that they are a part of, and as markers for traits linked to those genes. Such information may be useful in plant breeding in order to develop lines with desired phenotypes. Such use of CYP90B nucleic acids or variants thereof requires only a nucleic acid sequence of at least 15 nucleotides in length. The CYP90B nucleic acids or variants thereof may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the CYP90B nucleic acids or variants thereof. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the CYP90B nucleic acid or variant thereof in the genetic map previously obtained using this population (Botstein et al. (1980) Am. J. Hum. Genet. 32:314-331).

The production and use of plant gene-derived probes for use in genetic mapping is described in Bernatzky and Tanksley (1986) (GENETICS112 (4): 887-898). Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favor use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al., (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having increased yield, as described hereinbefore. This increased yield may also be combined with other economically advantageous traits, such as further yield-enhancing traits, tolerance to other abiotic and biotic stresses, traits modifying various architectural features and/or biochemical and/or physiological features.

Detailed Description CDC27

CDC27 polypeptides are well known in the art and are easily identifiable by the presence of a conserved $NH_2$ terminal region (see FIG. 16) and of at least 5 TPR domains with at least one TPR domain in the $NH_2$ terminal region. Furthermore, the CDC27 polypeptide may additionally comprise a sequence with more than 30% identity to SEQ ID NO: 130.

TPR motifs are present in a wide variety of proteins functional in yeast and higher eukaryotes in mitosis (including the APC protein components CDC16, CDC23 and CDC27), transcription, splicing, protein import and neurogenesis (Goebl and Yanagida 1991, Trends Biochem Sci 16, 173-177). A suggested minimal consensus sequence of the TPR motif is: $X_3$-W-$X_2$-L-G-$X_2$-Y-$X_8$-A-$X_3$-F-$X_2$-A-$X_4$-P-$X_2$, (SEQ ID NO: 286) where X=any amino acid (Lamb et al. 1994, EMBO J. 13, 4321-4328). The consensus residues may exhibit significant degeneracy and the non-consensus residues exhibit little or no homology. It is the hydrophobicity and size of the consensus residues, rather than their identity, that seems to be important. In a native CDC27 protein, the TPR forms an α-helical structure, tandem repeats organize into a superhelical structure ideally suited as interfaces for protein recognition (Groves and Barford 1999, Curr Opin Struct Biol 9, 383-389). Within the α-helix, two amphipathic domains are usually present, one at the $NH_2$ terminal region and the other near the COOH-terminal region (Sikorski et al. 1990, Cell 60, 307-317). Also individual TPR motifs may be dispersed throughout the protein sequence.

A full length native CDC27 typically comprises at least 5 TPRs, preferably 6 TPRs, more preferably 7 TPRs, the majority of those TPRs being located in the COOH terminal region. As shown in FIG. 16, there is typically one TPR domain in the $NH_2$ terminal region of a native CDC27 polypeptide, although variant CDC27 sequences may exist or may be created to comprise more than one TPR in the $NH_2$ terminal region.

Any CDC27 polypeptide may be rendered useful in the methods of the invention by inactivation of at least one TPR domain in the $NH_2$ terminal region of the polypeptide. Methods for inactivation are well known in the art and include: removal or substitution of amino acids, in this case, removal or substitution of amino acids of at least one TPR domain in the $NH_2$ terminal region; or mutation techniques, such as substituting conserved amino acids by alanine or substituting phosphorylatable amino acids (such as serine, threonine or tyrosine) by non-phosphorylatable amino acids or vice versa (depending if the phosphorylated protein is active or inactive); or any other method for inactivation.

For the purposes of this application, the $NH_2$ terminal region of a CDC27 protein is taken to be the first half of a full length CDC27 sequence (from $NH_2$ terminal to COOH terminal) (see FIG. 16); preferably the $NH_2$ terminal region of a CDC27 protein is taken to be the first third of a full length CDC27 sequence (from $NH_2$ terminal to COOH terminal); and according to another preferred feature of the present invention, the N-terminal region of a CDC27 protein is taken to be the first 166 amino acids (from $NH_2$ terminal to COOH terminal) of a full-length CDC27 sequence.

An example of a CDC27 polypeptide having at least one inactive TPR domain in the $NH_2$ terminal region is the polypeptide represented by SEQ ID NO: 130, with encoding nucleic acid sequence represented by SEQ ID NO: 129.

Table 10 below gives some examples of CDC27 sequences; these sequences may be rendered useful in the methods of the invention by inactivation of at least one TPR domain in the $NH_2$ terminal region of the polypeptide, for example by using any of the inactivation methods discussed hereinabove.

TABLE 10

Examples of CDC27 polypeptides

| Name | NCBI nucleotide accession number | Nucleotide SEQ ID NO | Translated polypeptide SEQ ID NO | Source |
|---|---|---|---|---|
| CDC27B | AC006081 | 129 | 130 | Arabidopsis thaliana |
| CDC27B/Hobbit | AJ487669 | 131 | 132 | Arabidopsis thaliana |
| CDC27a | NM_112503.2\| | 133 | 134 | Arabidopsis thaliana |
| CDC27 | AP003539.3 | 135 | 136 | Oryza sativa |
| CDC27 | BG887406.1* BG590616.1 DN939130.1 CV470643.1 | 137 | 139 | Solanum tuberosum |
| CDC27/nuc2+ | NM_001020032.1 | 139 | 140 | Schizosaccharomyces pombe |
| CDC27/BimA | X59269.1 | 141 | 142 | Aspergillus niger |
| CDC27 | NM_001256.2 | 143 | 144 | Homo sapiens |
| CDC27 5' | CA102186.1* CA279358.1 | 145 | 146 | Saccharum officinarum |
| CDC27 3' | CA197669.1* CA197670.1 CA203636.1 CA232307.1 | 147 | 148 | Saccharum officinarum |

*Contig compiled from several EST accessions (main ones shown); EST sequencing quality being usually lower, a few nucleic acid substitutions may be expected.

The sequences described in Table 10 are given by way of example only. Further examples are given in FIG. 19, encoding either full length or partial polypeptides (which may be used to obtain the full length sequence using routine methods). It is to be understood that any CDC27 polypeptide sequence having at least one inactive TPR domain in the $NH_2$ terminal region of the polypeptide, or a nucleic acid/gene encoding such a polypeptide, may be suitable for use in performing the methods of the invention.

Other CDC27 polypeptides may readily be identified using routine techniques well known in the art, such as by sequence alignment. Sequences so identified may subsequently be rendered useful in the methods of the invention by inactivation of at least one TPR domain in the $NH_2$ terminal region of the polypeptide, for example by using any of the inactivation methods discussed hereinabove. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the alignment of two complete sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information. Homologues of a CDC27 may readily be identified using, for example, the ClustalW multiple sequence alignment algorithm (version 1.83) available at http://clustalw.genome.jp/sit-bin/nph-ClustalW, with the default pairwise alignment parameters, and a scoring method in percentage. Minor manual editing may be performed to optimise alignment between conserved motifs, as would be apparent to a person skilled in the art.

Various structural domains in a CDC27 protein, such as TPR domains, may be identified using specialised databases e.g. SMART (Schultz et al. (1998) Proc. Natl. Acad. Sci. USA 95, 5857-5864; Letunic et al. (2002) Nucleic Acids Res 30, 242-244; http://smart.embl-heidelberg.deI), InterPro (Mulder et al., (2003) Nucl. Acids. Res. 31, 315-318; http://www.ebi.ac.uk/interproo), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134D137, (2004), http://www.expasy.org/prosite/), Pfam (Bateman et al., Nucleic Acids Research 30(1): 276-280 (2002), http://www.sanger.ac.uk/Software/Pfamo or Pro-Dom (Servant F, Bru C, Carrère S, Courcelle E, Gouzy J, Peyruc D, Kahn D (2002) ProDom:

Automated clustering of homologous domains. Briefings in Bioinformatics. vol 3, no 3:246-251).

The sequences mentioned in Table 10 and FIG. 19 may be considered homologues of a CDC27 polypeptide. "Homologues" of a protein are defined in the "Definitions" section herein. Preferred homologues are amino acid sequences having in increasing order of preference at least 30%, 40%, 50%, 60%, 70%, 80%, 85%, 90%, 95%, 96%, 97%, 98% or 99% or more sequence identity to the full-length CDC27 protein represented by SEQ ID NO: 132.

Homologues, orthologues and paralogues may be rendered useful in the methods of the invention by inactivation of at least one TPR domain in the $NH_2$ terminal region of the polypeptide, for example by using any of the inactivation methods discussed hereinabove.

Human and yeast CDC27 polypeptides have been shown to interact with two other proteins of the APC complex, CDC16 and CDC23, in vivo via yeast two-hybrid analysis, and in vitro via by co-immunoprecipitation (Lam et al. (1994) EMBO J. 13(18): 4321-4328; Ollendorf & Donoghue (1997) J Biol Chem 272(51): 32011-32018). Such an interaction may be useful to identify CDC27 polypeptides to be rendered useful in the methods of the invention by inactivation of at least one TPR domain in the $NH_2$ terminal region of the polypeptide, for example by using any of the inactivation methods discussed hereinabove A CDC27 polypeptide having at least one inactive TRP domain in the $NH_2$ terminal region of the polypeptide is encoded by a so-called modified CDC27 nucleic acid/gene.

Therefore, the term "modified CDC27 nucleic acid/gene" as defined herein is any nucleic acid/gene encoding a CDC27 polypeptide having at least one inactive TRP domain in the NH$_2$ terminal region of the polypeptide.

The CDC27 nucleic acid or modified CDC27 nucleic acid/gene may be derived from any natural or artificial source. The nucleic acid/gene may be isolated from a microbial source, such as yeast or fungi, or from a plant, algae or animal source. This nucleic acid may be modified from its native form in composition and/or genomic environment through deliberate human manipulation. The nucleic acid is preferably of plant origin, whether from the same plant species (for example to the one in which it is to be introduced) or whether from a different plant species. The nucleic acid may be isolated from a dicotyledonous species, preferably from the family Brassicaceae, further preferably from *Arabidopsis thaliana*. More preferably, the modified CDC27 nucleic acid isolated from *Arabidopsis thaliana* is represented by SEQ ID NO: 129 and the CDC27 having at least one inactive TPR in the NH$_2$ terminal region of the amino acid is as represented by SEQ ID NO: 130.

A CDC27 nucleic acid/gene is a nucleic acid capable of hybridising under reduced stringency conditions, preferably under stringent conditions, with a CDC27 nucleic acid/gene as represented by any one of SEQ ID NO: 129, SEQ ID NO: 131, SEQ ID NO: 133, SEQ ID NO: 135, SEQ ID NO: 137 or SEQ ID NO: 141. Most preferably the hybridising sequence is one that is capable of hybridising to a nucleic acid as represented by SEQ ID NO: 129 or SEQ ID NO: 131. Such hybridising sequences may be rendered useful in the methods of the invention by inactivation of at least one TPR domain in the NH$_2$ terminal region of the encoded polypeptide, for example by using any of the inactivation methods discussed hereinabove.

The term "hybridisation" is as defined herein in the "Definitions" section.

The CDC27 nucleic acid or modified CDC27 nucleic acid/gene may be in the form of an alternative splice variant. An alternative splice variant is defined in the "Definitions" section. Preferred are splice variants of any of the aforementioned CDC27 nucleic acids sequences, namely SEQ ID NO: 129, SEQ ID NO: 131, SEQ ID NO: 133, SEQ ID NO: 135, SEQ ID NO: 137 or SEQ ID NO: 141. Most preferred is a splice variant of a nucleic acid sequence as represented by SEQ ID NO: 129 or SEQ ID NO: 131. Such splice variants may be rendered useful in the methods of the invention inactivation of at least one TPR domain in the NH$_2$ terminal region of the encoded CDC27 polypeptide, for example by using any of the inactivation methods discussed hereinabove.

The CDC27 nucleic acid or modified CDC27 nucleic acid/gene may be in the form of an allelic variant of a nucleic acid encoding a truncated CDC27 polypeptide comprising at least one inactivated TPR domain in the NH$_2$ terminal region. Preferred are allelic variants of nucleic acid sequences represented by SEQ ID NO: 129, SEQ ID NO: 131, SEQ ID NO: 133, SEQ ID NO: 135, SEQ ID NO: 137 or SEQ ID NO: 141. Most preferred is an allelic variant of a nucleic acid sequence as represented by SEQ ID NO: 129 or SEQ ID NO: 131. Allelic variants exist in nature, and encompassed within the methods of the present invention is the use of these natural alleles. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms. Such allelic variants may be rendered useful in the methods of the invention inactivation of at least one TPR domain in the NH$_2$ terminal region of the encoded CDC27 polypeptide, for example by using any of the inactivation methods discussed hereinabove.

The CDC27 nucleic acid or modified CDC27 nucleic acid/gene may be generated by site-directed mutagenesis. Several methods are available to achieve site-directed mutagenesis, the most common being PCR based methods (Current Protocols in Molecular Biology, Wiley Eds http://www.4ulr.com/products/currentprotocols/index.html).

The CDC27 nucleic acid or modified CDC27 nucleic acid/gene may also be generated by directed evolution (see "Definitions" section for further details).

Such variants produced by site-directed mutagenesis or by directed evolution may be rendered useful in the methods of the invention inactivation of at least one TPR domain in the NH$_2$ terminal region of the encoded CDC27 polypeptide, for example by using any of the inactivation methods discussed hereinabove.

The expression of a modified CDC27 nucleic acid/gene encoding a CDC27 polypeptide having at least one inactive TPR domain in the NH$_2$ terminal region of the polypeptide may be increased by introducing a genetic modification (preferably in the locus of a CDC27 gene). The locus of a gene as defined herein is taken to mean a genomic region, which includes the gene of interest and 10 KB up- or down stream of the coding region.

The genetic modification is preferably introduced by introducing and expressing in a plant a nucleic acid encoding a CDC27 polypeptide having at least one inactive TPR domain in the NH$_2$ terminal region of the polypeptide. Following introduction of the genetic modification, there follows an optional step of selecting for increased expression (in shoot apical meristem tissue) of a modified nucleic acid encoding a CDC27 polypeptide having at least one inactive TPR domain in the NH$_2$ terminal region of the polypeptide, which increase in expression gives plants having increased yield.

According to a preferred aspect of the present invention, increased expression of the CDC27 nucleic acid is envisaged. Methods for increasing expression of genes or gene products are well documented in the art and include, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a CDC27 nucleic acid. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention to control the expression of the gene.

If polypeptide expression is desired, it is generally desirable to include a polyadenylation region at the 3'-end of a polynucleotide coding region. The polyadenylation region may be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. See generally, The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention.

Therefore, there is provided a gene construct comprising:
(i) A CDC27 nucleic acid encoding a CDC27 polypeptide having at least one inactivated TPR domain in the $NH_2$ terminal region of the polypeptide;
(ii) One or more control sequences capable of preferentially driving expression of the nucleic acid sequence of (i) in shoot apical meristem tissue; and optionally
(iii) A transcription termination sequence.

Such genetic constructs may be constructed using recombinant DNA technology well known to persons skilled in the art. The gene constructs may be inserted into vectors, which may be commercially available, suitable for transforming into plants and suitable for expression of the gene of interest in the transformed cells. The invention therefore provides use of a gene construct as defined hereinabove in the methods of the invention.

Plants are transformed with a vector comprising the sequence of interest (i.e., a nucleic acid encoding a CDC27 polypeptide having at least one inactive TPR domain in the $NH_2$ terminal region of the polypeptide. The sequence of interest is operably linked to one or more control sequences (at least to a promoter) capable of preferentially driving expression in shoot apical meristem tissue of a plant. The terms "regulatory elemen", "control sequence" and "promoter" are all used interchangeably herein and are defined in the "Definitions" section.

The CDC27 nucleic acid encoding a CDC27 polypeptide having at least one inactive TPR domain in the $NH_2$ terminal region of the polypeptide or variant is operably linked to a shoot apical meristem promoter, preferably to an early shoot apical meristem promoter. An "early shoot apical meristem promoter" as defined herein is a promoter that is transcriptionally active in the shoot apical meristem from the embryo globular stage up to the young seedling stage, these stages being well known to persons skilled in the art. Reference herein to preferentially increasing expression in shoot apical meristem tissue is taken to mean increasing expression in shoot apical meristem tissue substantially to the exclusion of expression elsewhere in the plant, apart from any residual expression due to leaky promoters. Preferably, the early shoot apical meristem promoter is an OSH1 promoter (from rice; SEQ ID NO: 151 (Matsuoka et al., (1993) Plant Cell 5: 1039-1048; Sato et al., (1996) Proc Natl Acad Sci USA 93(15): 8117-22). It should be clear that the applicability of the present invention is not restricted to the modified CDC27 nucleic acid represented by SEQ ID NO: 129, nor is the applicability of the invention restricted to expression of a modified CDC27 nucleic acid when driven by an OSH1 promoter. Examples of other early shoot apical meristem promoters are shown in Table 5 in the "Definitions" section. These are members of the KNOX family class 1 homeobox, from paralogous or orthologous genes. It should be understood that the list below is non-exhaustive.

Optionally, one or more terminator sequences may also be used in the construct introduced into a plant. The term "terminator" is defined herein in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene as defined in the "Definitions" section.

The present invention also encompasses plants obtainable by the methods according to the present invention. The present invention therefore provides plants or parts thereof, including plant cells, obtainable by the method according to the present invention, which plants or plant parts comprise a CDC27 nucleic acid encoding a CDC27 polypeptide having at least one inactive TPR domain in the $NH_2$ terminal region of the polypeptide and which nucleic acid is operably linked to a shoot apical meristem promoter.

The invention also provides a method for the production of transgenic plants having increased seed number relative to suitable control plants, comprising introduction and expression in a plant of a CDC27 nucleic acid encoding a CDC27 polypeptide having at least one inactive TPR domain in the $NH_2$ terminal region of the polypeptide, which CDC27 nucleic acid is under the control of a shoot apical meristem promoter.

More specifically, the present invention provides a method for the production of transgenic plants having increased seed number relative to suitable control plants, which method comprises:
(i) introducing and expressing in a plant, plant part or plant cell a CDC27 nucleic acid encoding a CDC27 polypeptide having at least one inactive TPR domain in the $NH_2$ terminal region of the polypeptide, which nucleic acid is under the control of a shoot apical meristem promoter; and
(ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation.

The term "transformation" is defined in the "Definitions" section.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated CDC27 nucleic acid encoding a CDC27 polypeptide having at least one inactive TPR domain in the $NH_2$ terminal region of the polypeptide and which nucleic acid is under the control of a shoot apical meristem promoter. Preferred host cells according to the invention are plant cells.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty adds, starch or proteins.

The present invention also encompasses use of CDC27 nucleic acids encoding CDC27 polypeptides having at least one inactive TPR domain in the NH₂ terminal region of the polypeptide, which nucleic acids are under the control of a shoot apical meristem promoter. Such uses relate to increasing plant yield as defined hereinabove in the methods of the invention.

Performance of the methods according to the present invention result in plants having increased seed number relative to suitable control plants. This increase in seed number may also be combined with other economically advantageous traits, such as further yield-enhancing traits, tolerance to other abiotic and biotic stresses, traits modifying various architectural features and/or biochemical and/or physiological features.

Detailed Description AT-hook

AT-hook domains are well known in the art and are typically found in polypeptides belonging to a family of transcription factors associated with Chromatin remodeling. The AT-hook motif is made up of 13 or so (sometimes about 9) amino acids which participate in DNA binding and which have a preference for A/T rich regions. In *Arabidopsis* there are at least 34 proteins containing AT-hook domains. These proteins share homology along most of the sequence, with the AT-hook domain being a particularly highly conserved region. The AT-hook domain is illustrated in FIG. 23 and Table 11 hereinafter, see also the appropriate annotation of SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169 and SEQ ID NO: 171 where the position of the AT-hook domain is specified. As shown in the alignment of FIG. 23, some variation within the AT-hook domain is allowed. Typically, one or two AT-hook domains precede the DUF296 domain. Reference herein to an AT-hook domain is taken to mean a polypeptide sequence having in increasing order of preference at least 70%, 75%, 80%, 85%, 90% or 95% identity to the AT-hook domain of SEQ ID NO: 153, which is repeated here for convenience: RRPRGRPAGSKNK (AT-hook domain of SEQ ID NO: 153).

DUF296 domains (referred to in Interpro as IPR005175) are also well known in the art. The DUF296 domain is illustrated in FIG. 23 and Table 11 hereinafter; see also the appropriate annotation of SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169 and SEQ ID NO: 171, where the position of the DUF296 domain is specified. As shown in the alignment of FIG. 23, variation within the DUF296 domain is allowed whilst still being easily identified as a DUF296 domain due to the presence of some highly conserved amino acid residues. Typically, the DUF296 domain is preceded by one or two AT-hook domains.

According to a preferred feature of the present invention, polypeptides comprising an AT-hook domain and a DUF296 domain additionally comprise one of the following motifs:
Motif 1 (SEQ ID NO: 190): QGQ V/I GG; or
Motif 2 (SEQ ID NO: 191): ILSLSGSFLPPPAPP; or
Motif 3 (SEQ ID NO: 192): NATYERLP; or
Motif 4 (SEQ ID NO: 193): SFTNVAYERLPL with zero or one amino acid change at any position; or
Motif 5 (SEQ ID NO: 194): GRFEILSLTGSFLPGPAPPG-STGLTIYLAGGQGQWGGSWG with zero, one or two amino acid changes at any position.

According to a preferred feature of the present invention, sequences suitable for use in the methods of the invention are polypeptides comprising an AT-hook domain (as defined hereinabove) and a DUF296 domain (as defined hereinabove) and Motif 2 (as defined hereinabove), or nucleic acids encoding such polypeptides.

It is to be understood that the sequences detailed in Table 1 and those shown in the alignment of FIG. 23 are only examples of sequences useful in the methods of the invention and that any polypeptide having an AT-hook domain and a DUF296 domain, or any nucleic acid encoding the same, may be suitable for use in performing the methods of the invention.

TABLE 11

Examples of amino acid sequences comprising an AT-hook domain and a DUF296 domain with details of the sequences of these domains and their respective positions

| | SEQ ID NO | Species | AT Hook domain position | sequence AT Hook domain | Duf296 domain position | sequence DUF296 domain |
|---|---|---|---|---|---|---|
| 1 | SEQ ID NO: 153 CDS3129 | ORYSA | 97-109 | rrprgrpagsknk | 124-241 | lrthvmevaggcdisesitt farrrqrgvcvlsgagtvtn vtlrqpasqgavvalhgrfe ilslsgsflpppappeatgl tvylaggqgqvvggsvvgal taagpvvimaasfanavy |
| 2 | SEQ ID NO: 155 CDS3128 | ORYSA | 97-109 | RRPRGRPPGSKNK | 109-227 | lrahilevgsgcdvfecvst yarrrqrgvcvlsgsgvvtn vtlrqpsapagavvslhgrf eilslsgsflpppappgats ltiflaggqgqvvggnvvga lyaagpviviaasfanvay |
| 3 | SEQ ID NO: 157 LOTUS LOTCO-AP006863.1 (gi68264919) | LOTUS | 81-93 | rrprgrpagsknk | 108-225 | lkthvmevadgcdivdsvsn farrrqrgvcimsgtgtvtn vtlrqpassgavvtlhgrfe ilslagsflpppappaasgl tiylaggqgqvvggsvvgal iasgpvvimaasfsnaay |
| 4 | SEQ ID NO: 159 NP_192942 | ARATH | 119-131 | RRPRGRPAGSKNK | 145-263 | lrthvmeigdgcdivdcmat farrrqrgvcvmsgtgsvtn vtirqpgsppgsvvslhgrf |

TABLE 11-continued

Examples of amino acid sequences comprising an AT-hook domain and a DUF296 domain with details of the sequences of these domains and their respective positions

| | SEQ ID NO | Species | AT Hook domain position | sequence AT Hook domain | Duf296 domain position | sequence DUF296 domain |
|---|---|---|---|---|---|---|
| | | | | | | eilslsgsflpppappaatg lsvylaggqgqvvggsvvgp llcsgpvvvmaasfsnaay |
| 5 | SEQ ID NO: 161 ARATH NP_194012 | | 105-117 | rrprgrpagsknk | 132-252 | farrrqrgvcvmsgtgnvtn vtirqpgshpspgsvvslhg rfeilslsgsflpppappta tglsvylaggqgqvvggsvv gpllcagpvvvmaasfsna |
| 6 | SEQ ID NO: 163 ARATH NP_182067 | | 89-101 | rrprgrpagsknk | 116-237 | lkshvmevangcdvmesvtv farrrqrgicvlsgngavtn vtirqpasvpgggssvvnlh grfeilslsgsflpppappa asgltiylaggqgqvvggsv vgplmasgpvvimaasfgna ay |
| 7 | SEQ ID NO: 165 ARATH At3g60870/At _NP_191646 | | 59-71 | rrprgrpagsknk | 86-201 | frchvmeitnacdvmeslav farrrqrgvcvltgngavtn vtvrqpgggvvslhgrfeil slsgsflpppappaasglkv ylaggqgqviggsvvgplta sspvvvmaasfgnasy |
| 8 | SEQ ID NO: 167 ARATH CDS0185 | | 88-100 | rrprqrppgsknk | 115-233 | lqshvleiatgadvaeslna farrrqrgrgvsvlSgsglvtn vtlrqpaasggvvslrgqfe ilsmcgaflptsgspaaaag ltiylagaqgqvvgggvagp liasgpviviaatfcnaty |
| 9 | SEQ ID NO: 169 ORYSA PROT encoded by AK107405 | | 111-123 | rrprgrpagsknk | 138-256 | lrahvlevasgcdlvdsvat farrrqvgvcvlsatgavtn vsvrqpgaqpgavvnltgrf dilslsgsflpppappsatg ltvyvsggqgqvvggtvagp liavgpvvimaasfgnaay |
| 10 | SEQ ID No: 171 ORYSA NP_912386.1 | | 45-57 | rrprgrppgsknk | 72-190 | mrshvleiasgadiveaiag fsrrrqrgvsvlsgsgavtn vtlrqpagtgaaavalrgrf eilsmsgaflpapappgatg lavylaggqgqvvggsvmge liasgpvmviaatfgnaty |
| 11 | SEQ ID NO: 173 LYCES Le_BT013387 | | 54-66 | rrprgrpagsknk | 81-198 | lrahilevssghdvfesvat yarkrqrgicilsgsgtvnn vtirqpqaagsvvtlhgrfe ilslsgsflpppappgatsl tiylaggqgqvvggnvvgal iasgpviviassftnvay |
| 12 | SEQ ID NO: 175 ARATH CDS3125 | | 34-46 | rrprgrpagsknk | 61-180 | lrshvlevtsgsdiseavst yatrrgcgvciisgtgavtn vtirgpaapagggvitlhgr fdilsltgtalpppappgag gltvylaggqgqvvggnvag sliasgpvvlmaasfanavy |
| 13 | SEQ ID NO: 177 ARATH CDS3399 | | 80-92 | rrprgrpagsknk | 107-232 | lkshvmeiasgtdvietlat farrrqrgicilsgngtvan vtlrqpstaavaaapggaav lalqgrfeilsltgsflpgp appgstgltiylaggqgqvv ggsvvgplmaagpvmliaat fsnaty |
| 14 | SEQ ID NO: 179 ORYSA PRO AK110263 | | 35-47 | rrprgrppgsknk | 62-179 | lrshvmevaggadvaesiah farrrqrgvcvlsgagtvtd valrcqpaapsavvlrgrfe ilsltgtflpgpappgstgl |

TABLE 11-continued

Examples of amino acid sequences comprising an AT-hook domain and a DUF296 domain with details of the sequences of these domains and their respective positions

| | SEQ ID NO | Species | AT Hook domain position | sequence AT Hook domain | Duf296 domain position | sequence DUF296 domain |
|---|---|---|---|---|---|---|
| | | | | | | tvylaggqgqvvggsvvgtl taagpvmv |
| 15 | SEQ ID NO: 191 At4g14465/NP_567432 | ARATH | 67-79 | rrprgrppgsknk | 94-211 | lrshvleisdgsdvadtiah fsrrrqrgvcvlsgtgsvan vtlrqaaapggvvslqgrfe ilsltgaflpgpsppgstgl tvylagvqgqvvggsvvgpl laigsvmviaatfsnaty |
| 16 | SEQ ID NO: 183 CDS4145 | ARATH | 82-94 | rrprgrppgsknk | 109-226 | lrahilevtngcdvfdcvat yarrrqrgicvlsgsgtvtn vsirqpsaagavvtlqgtfe ilslsgsflpppappgatsl tiflaggqgqvvggsvvgel taagpviviaasftnvay |
| 17 | SEQ ID NO: 185 XP_473716 | ORYSA | 82-94 | rrprgrppgsknk | 109-227 | lrahilevgsgcdvfecvst yarrrqrgvcvlsgsgvvtn vtlrqpsapagavvslhgrf eilslsgsflpppappgats ltiflaggqgqvvggnvvga lyaagpviviaasfanvay |
| 18 | SEQ ID NO: 187 NP_181070 | ARATH | 78-90 | rrprgrpagsknk | 105-222 | lrahilevgsgcdvfecist yarrrqrgicvlsgtgtvtn vsirqptaagavvtlrgtfe ilslsgsflpppappgatsl tiflagaqgqvvggnvvgel maagpvmvmaasftnvay |
| 19 | SEQ ID NO: 189 TC102931 | TC102931 | 86-98 | rrprgrpagsknk | 113-230 | lrshvmevangcdimesvtv farrrgrgvcilsgsgtvtn vtlrqpaspgavvtlhgrfe ilslsgsflpppappaasgl aiylaggqgqvvggsvvgpl lasgpvvimaasfgnaay |

A person skilled in the art will readily be able to identify polypeptides comprising an AT-hook domain and a DUF296 domain using techniques and tools well known in the art. Such identification may be by sequence alignment for comparison of sequences using GAP, BESTFIT, BLAST, FASTA and TFASTA. GAP uses the algorithm of Needleman and Wunsch ((1970) J Mol Biol 48: 443-453) to find the alignment of two complete sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information. Polypeptides comprising an AT-hook domain and a DUF296 domain may readily be identified using, for example, the ClustalW multiple sequence alignment algorithm (version 1.83) available at http://clustalw.genome.jp/sit-bin/nph-ClustalW, with the default pairwise alignment parameters, and a scoring method in percentage. Minor manual editing may be performed to optimise alignment between conserved motifs, as would be apparent to a person skilled in the art.

The AT-hook domain and the DUF296 domain may be identified using specialised databases e.g. SMART (Schultz et al. (1998) Proc. Natl. Acad. Sd. USA 95, 5857-5864; Letunic et al. (2002) Nucleic Acids Res 30, 242-244; http://smart.embl-heidelberg.de/), InterPro (Mulder et al., (2003) Nucl. Acids. Res. 31, 315318; http://www.ebi.ac.uk/interpro/), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), http://www.expasy.org/prosite/) or Pfam (Bateman et al., Nucleic Acids Research 30(1):276-280 (2002), http://www.sanger.ac.uk/Software/Pfam/).

The sequences mentioned in Table 11, or as identified using the techniques mentioned above (such as sequence alignment), may be considered homologues of a polypeptide comprising an AT-hook domain and a DUF296 domain, which homologues also comprise an AT-hook domain and a DUF296 domain but which may vary elsewhere in the sequence. "Homologues" of a protein are defined in the "Definitions" section herein. Preferred homologues are amino acid sequences having in increasing order of preference at least 30%, 40%, 50%, 60%, 70%, 80%, 85%, 90%, 95%, 96%, 97%, 98% or 99% or more sequence identity to the amino acid sequence represented by SEQ ID NO: 153, which homologues comprise an AT-hook domain and a DUF296 domain and further preferably comprise Motif 2.

The polypeptide comprising an AT-hook domain and a DUF296 domain, or a homologue of such polypeptide, may be a derivative, as defined in the "Definitions" section herein.

Any nucleic acid encoding a polypeptide comprising an AT-hook domain and a DUF296 domain may be suitable for use in the methods of the invention. Examples of such sequences include those nucleotide sequences represented by SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168 and SEQ ID NO: 170.

Variants of a nucleic acid encoding a polypeptide comprising an AT-hook domain and a DUF296 domain may also be suitable for use in practising the methods of the invention so long as the variants encode polypeptides comprising an AT-hook domain and a DUF296 domain. Such nucleic acid variants may be portions of a nucleic acid encoding a polypeptide comprising an AT-hook domain and a DUF296 domain and/or nucleic acids capable of hybridising with a nucleic acid encoding a polypeptide comprising an AT-hook domain and a DUF296 domain.

A portion may be prepared, for example, by making one or more deletions to a nucleic acid encoding a polypeptide comprising an AT-hook domain and a DUF296 domain. The portions may be used in isolated form or they may be fused to other coding (or non coding) sequences in order to, for example, produce a protein that combines several activities. When fused to other coding sequences, the resulting polypeptide produced upon translation may be bigger than that predicted for the portion. Preferably, the portion is a portion of a nucleic acid as represented by any one of SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168 and SEQ ID NO: 170. Most preferably the portion is a portion of a nucleic acid as represented by SEQ ID NO: 152, which portion encodes a polypeptide comprising an AT-hook domain and a DUF296 domain and further preferably comprises Motif 2.

Another nucleic acid variant is a nucleic acid capable of hybridising under reduced stringency conditions, preferably under stringent conditions, with a nucleic acid encoding a polypeptide comprising an AT-hook domain and a DUF296 domain. Preferably, the hybridising sequence is one that is capable of hybridising to a nucleic acid as represented by any one of SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168 and SEQ ID NO: 170, or to a portion of any of the aforementioned sequences as defined hereinabove. Most preferably, the hybridising sequence is one that is capable of hybridising to a nucleic acid as represented by SEQ ID NO: 152, which hybridizing sequence encodes a polypeptide comprising an AT-hook domain and a DUF296 domain and further preferably comprises Motif 2.

The term "hybridisation" is as defined herein in the "Definitions" section.

Another nucleic acid variant is an alternative splice variant, as defined in the "Definitions" section. Preferred are splice variants of nucleic acid sequences represented by SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168 and SEQ ID NO: 170. Most preferred is a splice variant of a nucleic acid sequence as represented by SEQ ID NO: 152, which splice variant encodes a polypeptide comprising an AT-hook domain and a DUF296 domain and further preferably comprising Motif 2.

Another nucleic acid variant is an allelic variant as defined in the "Definitions" section. Preferred are allelic variants of nucleic acid sequences represented by SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168 and SEQ ID NO: 170. Most preferred is an allelic variant of a nucleic acid sequence as represented by SEQ ID NO: 152, which allelic variant encodes a polypeptide comprising an AT-hook domain and a DUF296 domain and further preferably comprises Motif 2.

Nucleic acid variants may also be obtained through directed evolution (see "Definitions" section).

Site-directed mutagenesis may also be used to generate variants of a nucleic acid encoding a polypeptide comprising an AT-hook domain and a DUF296 domain. See "Definitions" section.

The nucleic acid encoding a polypeptide comprising an AT-hook domain and a DUF296 domain may be derived from any natural or artificial source. The nucleic acid/gene or variant thereof may be isolated from a microbial source, such as yeast or fungi, or from a plant, algae or animal source. This nucleic acid may be modified from its native form in composition and/or genomic environment through deliberate human manipulation. The nucleic acid is preferably of plant origin, whether from the same plant species (for example to the one in which it is to be introduced) or whether from a different plant species. The nucleic acid may be isolated from a dicotyledonous species, preferably from a monocotyledonous species such as rice. More preferably, the rice nucleic acid encoding a polypeptide comprising an AT-hook domain and a DUF296 domain is represented by SEQ ID NO: 152 and the encoded polypeptide is as represented by SEQ ID NO: 153.

The expression of an AT-hook-encoding nucleic acid may be modulated by introducing a genetic modification (preferably in the locus of a gene encoding a polypeptide comprising an AT-hook domain and a DUF296 domain). The locus of a gene as defined herein is taken to mean a genomic region, which includes the gene of interest and 10 kb up- or downstream of the coding region.

The genetic modification may be introduced, for example, by any one (or more) of the following methods: T-DNA activation, TILLING, homologous recombination and by introducing and expressing in a monocotyledonous plant a nucleic acid encoding a polypeptide comprising an AT-hook domain and a DUF296 domain. See the "Definitions" section for details of T-DNA activation, TILLING and homologous recombination. Following introduction of the genetic modification, there may follow a step of selecting for increased expression in endosperm tissue of a nucleic acid encoding a polypeptide comprising an AT-hook domain and a DUF296 domain, which targeted expression gives plants having increased seed yield.

The choice of promoter for T-DNA activation tagging in the case of the present invention would be any promoter capable of preferentially directing expression in endosperm tissue of a monocotyledonous plant.

T-DNA activation and TILLING are examples of technologies that enable the generation of novel alleles and variants of a nucleic acid encoding a polypeptide comprising an AT-hook domain and a DUF296 domain.

A preferred method for introducing a genetic modification (which in this case need not be in the locus of a nucleic acid/gene encoding a polypeptide comprising an AT-hook domain and a DUF296 domain) is to introduce and express in a plant a nucleic acid encoding a polypeptide comprising an AT-hook domain and a DUF296 domain. The nucleic acid to be introduced into a plant may be a full-length nucleic acid or may be a portion or any other variant nucleic acid so long as the variant nucleic-acid encodes a polypeptide comprising an AT-hook domain and a DUF296 domain.

The methods of the present invention rely on preferentially increasing expression in endosperm tissue of a monocotyledonous plant of a nucleic acid encoding a polypeptide comprising an AT-hook domain and a DUF296 domain. This may be achieved by overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a gene/nucleic acid or variant thereof encoding a polypeptide comprising an AT-hook domain and a DUF296 domain. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention to control expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. See generally, The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention.

Therefore, there is provided a gene construct comprising:
(i) A nucleic acid encoding a polypeptide comprising an AT-hook domain and a DUF296 domain;
(ii) One or more control sequences capable of driving expression of the nucleic acid sequence of (i) in endosperm tissue of a monocotyledonous plant; and optionally
(iii) A transcription termination sequence.

The invention also provides use of a construct as defined hereinabove in methods for increasing seed yield of a monocotyledonous plant.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells. The invention also provides use of a construct as defined hereinabove in methods for increasing seed yield in a monocotyledonous plant.

Monocotyledonous plants are transformed with a vector comprising the sequence of interest (i.e., a nucleic acid encoding a polypeptide comprising an AT-hook domain and a DUF296 domain). The sequence of interest is operably linked to one or more control sequences (at least to a promoter) capable of preferentially increasing expression in endosperm tissue of a monocotyledonous plant. The terms "regulatory element", "control sequence" and "promoter" are all used interchangeably herein and are defined in the "Definitions" section.

An endosperm-specific promoter refers to any promoter able to preferentially drive expression of the gene of interest in endosperm tissue. Reference herein to preferentially increasing expression in endosperm tissue is taken to mean increasing expression in endosperm tissue substantially to the exclusion of expression elsewhere in the plant, apart from any residual expression due to leaky promoters. For example, the prolamin promoter shows strong expression in the endosperm, with leakiness in meristem, more specifically the shoot meristem and/or discrimination centre in the meristem.

Preferably, the endosperm-specific promoter is a promoter isolated from a prolamin gene, such as a rice prolamin RP6 (Wen et al., (1993) Plant Physiol 101(3):1115-6) promoter as represented by SEQ ID NO: 195 or a promoter of similar strength and/or a promoter with a similar expression pattern as the rice prolamin promoter. Similar strength and/or similar expression pattern may be analysed, for example, by coupling the promoters to a reporter gene and checking the function of the reporter gene in tissues of the plant. One well-known reporter gene is beta-glucuronidase and the calorimetric GUS stain used to visualize beta-glucuronidase activity in plant tissue. It should be clear that the applicability of the present invention is not restricted to the nucleic acid represented by SEQ ID NO: 152, nor is the applicability of the invention restricted to expression of a nucleic acid encoding an AT-hook domain and a DUF296 domain when driven by a prolamin promoter. Examples of other endosperm-specific promoters which may also be used perform the methods of the invention are shown in Table 6 in the "Definitions" section.

Optionally, one or more terminator sequences may also be used in the construct introduced into a plant. The term "terminator" is defined in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene as defined herein.

In a preferred embodiment, there is provided a gene construct comprising:
(i) A nucleic acid encoding a polypeptide comprising an AT-hook domain and a DUF296 domain;
(ii) A prolamin promoter capable of preferentially driving expression of the nucleic acid sequence of (i) in endosperm tissue of a monocotyledonous plant; and optionally
(iii) A transcription termination sequence.

The present invention also encompasses monocotyledonous plants obtainable by the methods according to the present invention. The present invention therefore provides monocotyledonous plants, parts thereof (including plant cells) obtainable by the methods according to the present invention, which plants or parts thereof comprise a transgene encoding a polypeptide comprising an AT-hook domain and a DUF296 domain operably linked to an endosperm-specific promoter, preferably to a prolamin promoter.

The invention also provides a method for the production of transgenic monocotyledonous plants having increased seed yield relative to suitable control plants, comprising introduction and expression in a monocotyledonous plant of a nucleic acid encoding a polypeptide comprising an AT-hook domain and a DUF296 domain, wherein said expression is preferentially increased in endosperm tissue of a monocotyledonous plant.

More specifically, the present invention provides a method for the production of transgenic monocotyledonous plants having increased seed yield which method comprises:
(i) introducing and preferentially increasing expression in endosperm tissue of a monocotyledonous plant of a nucleic acid encoding a polypeptide comprising an AT-hook domain and a DUF296 domain; and
(ii) cultivating the plant cell under conditions promoting plant growth and development.

The nucleic acid may be introduced directly into a plant cell of a monocotyledonous plant or into the plant itself (including introduction into a tissue, organ or any other part of a plant). According to a preferred feature of the present invention, the nucleic acid is preferably introduced into a plant by transformation.

The term "transformation" is defined in the "Definitions" section herein.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing a nucleic acid encoding a polypeptide comprising an AT-hook domain and a DUF296 domain operably linked to an endosperm-specific promoter. Preferred host cells according to the invention are monocotyledonous plant cells.

The invention also extends to harvestable parts of a monocotyledonous plant such. as, but not limited to seeds, leaves, fruits, flowers, stems, rhizomes, tubers and bulbs. The invention furthermore relates to products derived from, preferably directly derived from, a harvestable part of such a plant, such as dry pellets or powders, oil, fat and fatty acids, starch or proteins.

The present invention also encompasses use of a nucleic acid encoding a polypeptide comprising an AT-hook domain and a DUF296 domain in Increasing seed yield of a monocotyledonous plant using the methods of the invention.

Detailed Description DOF Transcription Factors

The term "DOF transcription factor polypeptide" as defined herein refers to any polypeptide comprising feature (i) as follows, and additionally either feature (ii) or (iii) as follow:
(i) in increasing order of preference at least 60%, 65%, 70%, 75%, 80%, 85%, 90% or 95% sequence identity to either the DOF domain represented by SEQ ID NO: 200 or SEQ ID NO: 228; and
(ii) in increasing order of preference at least 70%, 75%, 80%, 85%, 90% or 95% sequence identity to the DOF domain represented by SEQ ID NO: 200; or
(iii) Motif I: KALKKPDKILP (SEQ ID NO: 229) with no changes; or with one or more conservative change at any position; or with one, two or three non-conservative change(s) at any position; and/or
Motif II: DDPGIKLFGKTIPF (SEQ ID NO: 230) with no changes; or with one or more conservative change at any position; or with one, two or three non-conservative change(s) at any position.

Additionally, polypeptides comprising feature (i) and feature (iii) above may comprise any one, any two or all three of the following motifs:
Motif III: SPTLGKHSRDE (SEQ ID NO: 231) with no changes; or with one or more conservative change at any position; or with one, two or three non-conservative change(s) at any position; and/or
Motif IV: LQANPAALSRSQNFQE (SEQ ID NO: 232) with no changes; or with one or more conservative change at any position; or with one, two or three non-conservative change(s) at any position; and/or
Motif V: KGEGCLWVPKTLRIDDPDEAAKSSIWT-TLGIK (SEQ ID NO: 233) with no changes; or with one or more conservative change at any position; or with one, two, three, four or five non-conservative change(s) at any position.

A preferred polypeptide comprising feature (i) and feature (iii) above comprises both Motif I and II.

Furthermore, DOF transcription factor polypeptides (at least in their native form) typically have DNA-binding activity and have an activation domain. The presence of an activation domain and DNA-binding activity may easily be determined by a person skilled in the art using routine techniques and procedures.

SEQ ID NO: 199 (encoded by SEQ ID NO: 198) is an example of a DOF transcription factor polypeptide comprising features (i) and (ii) as defined hereinabove, i.e. at least 60% sequence identity to either the DOF domain represented by SEQ ID NO: 200 or SEQ ID NO: 228; and at least 70% sequence identity to the DOF domain represented by SEQ ID NO: 200. Further examples of DOF transcription factor polypeptides comprising features (i) and (ii) as defined hereinabove are given in SEQ ID NO: 202 (encoded by SEQ ID NO: 201), SEQ ID NO: 204 (encoded by SEQ ID NO: 203). SEQ ID NO: 206 (encoded by SEQ ID NO: 205), SEQ ID NO: 208 (encoded by SEQ ID NO: 207), SEQ ID NO: 210 (encoded by SEQ ID NO: 209), SEQ ID NO: 212 (encoded by SEQ ID NO: 211), SEQ ID NO: 214 (encoded by SEQ ID NO: 213), SEQ ID NO: 216 (encoded by SEQ ID NO: 215), SEQ ID NO: 218 (encoded by SEQ ID NO: 217), SEQ ID NO: 220 (encoded by SEQ ID NO: 219), SEQ ID NO: 222 (encoded by SEQ ID NO: 221).

SEQ ID NO: 227 (encoded by SEQ ID NO: 226) is an example of a DOF transcription factor polypeptide comprising features (i) and (iii) as defined hereinabove, i.e. at least 60% sequence identity to either the DOF domain represented by SEQ ID NO: 200 or SEQ ID NO: 228; and Motif I and/or Motif II as defined hereinabove. Further examples of DOF transcription factor polypeptides comprising features (i) and (iii) as defined hereinabove are given in SEQ ID NO: 235 (encoded by SEQ ID NO: 234), SEQ ID NO: 237 (encoded by SEQ ID NO: 236), SEQ ID NO: 239 (encoded by SEQ ID NO: 238), SEQ ID NO: 241 (encoded by SEQ ID NO: 240), SEQ ID NO: 243 (encoded by SEQ ID NO: 242), SEQ ID NO: 245 (encoded by SEQ ID NO: 244), SEQ ID NO: 247 (encoded by SEQ ID NO: 246), SEQ ID NO: 249 (encoded by SEQ ID NO: 248), SEQ ID NO: 251 (encoded by SEQ ID NO: 250), SEQ ID NO: 253 (encoded by SEQ ID NO: 252), SEQ ID NO: 255 (encoded by SEQ ID NO: 254).

The further examples represented by SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO:

216, SEQ ID NO: 218, SEQ ID NO: 220, SEQ ID NO: 222 are examples of "homologues" of a DOF transcription factor polypeptide represented by SEQ ID NO: 199.

The further examples represented by SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255 are examples of "homologueso of a DOF transcription factor polypeptide represented by SEQ ID NO: 227.

"Homologues" of a protein are as defined herein in the uDefinitions" section.

The DOF transcription factor polypeptide or homologue thereof may be a derivative. "Derivabves" are defined in the "Definitions" section herein.

The various structural domains in a DOF transcription factor protein, such as the DOF domain, may be identified using specialised databases e.g. SMART (Schultz et al. (1998) Proc. Natl. Acad. Sci. USA 95, 5857-5864; Letunic et al. (2002) Nucleic Acids Res 30, 242-244; http://smart.embl-heidelberg.de/), InterPro (Mulder et al., (2003) Nucl. Acids. Res. 31, 315-318; http://www.ebi.ac.uk/interpro/), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searis D., Eds., pp 5361, AAAIPress, Menlo Park; Hulo et al., Nucl. Acids. Res. 32:D134-D137, (2004), http://www.expasy.org/prositeq or Pfam (Bateman et al., Nucleic Acids Research 30(1): 276-280 (2002), http://www.sanger.ac.uk/Software/Pfam/).

Examples of nucleic acids encoding DOF transcription factor polypeptides (and homologues thereof) include those represented by any one of: SEQ ID NO: 198, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 226, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252 and SEQ ID NO: 254. Variants of nucleic acids encoding DOF transcription factor polypeptides may be suitable for use in the methods of the invention. Suitable variants include portions of nucleic acids encoding DOF transcription factor polypeptides and/or nucleic acids capable of hybridising with nucleic acids/genes encoding DOF transcription factor polypeptides. Further variants include splice variants and allelic variants of nucleic acids encoding DOF transcription factor polypeptides (and homologues thereof).

The term "portion" as defined herein refers to a piece of DNA encoding a polypeptide comprising feature (i) as follows, and additionally either feature (ii) or (iii) as follow:

(i) in increasing order of preference at least 60%, 65%, 70%, 75%, 80%, 85%, 90% or 95% sequence identity to either the DOF domain represented by SEQ ID NO: 200 or SEQ ID NO: 228; and (ii) in increasing order of preference at least 70%, 75%, 80%, 85%, 90% or 95% sequence identity to the DOF domain represented by SEQ ID NO: 200; or (iii) Motif I: KALKKPDKILP (SEQ ID NO: 229) with no changes; or with one or more conservative change at any position; or with one, two or three non-conservative change(s) at any position; and/or Motif II: DDPGIKLFGKTIPF (SEQ ID NO: 230) with no changes; or with one or more conservative change at any position; or with one, two or three non-conservative change(s) at any position.

Additionally feature (iii) above may comprise any one, any two or all three of the following motifs:

Motif III: SPTLGKHSRDE (SEQ ID NO: 231) with no changes; or one or more conservative change at any position; or with one, two or three non-conservative change(s) at any position; and/or Motif IV: LQANPAALSRSQNFQE (SEQ ID NO: 232) with no changes; or with one or more conservative change at any position; or with one, two or three non-conservative change(s) at any position; and/or Motif V: KGEGCLWVPKTLRIDDPDEAAKSSIWTr-LGIK (SEQ ID NO: 233) with no changes; or with one or more conservative change at any position; or with one, two, three, four or five non-conservative change(s) at any position.

A portion may be prepared, for example, by making one or more deletions to a nucleic acid encoding a DOF transcription factor polypeptide. The portions may be used in isolated form or they may be fused to other coding (or non coding) sequences in order to, for example, produce a protein that combines several activities. When fused to other coding sequences, the resulting polypeptide produced upon translation may be bigger than that predicted for the DOF transcription factor portion.

Nucleic acid portions encoding DOF transcription factor polypeptides comprising features (i) and (ii) as defined hereinabove are preferably portions of a nucleic acid as represented by any one of: SEQ ID NO: 198, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219 and SEQ ID NO: 221.

Nucleic acid portions encoding DOF transcription factor polypeptides comprising features (i) and (iii) as defined hereinabove are preferably portions of a nucleic acid as represented by any one of: SEQ ID NO: 226, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252 and SEQ ID NO: 254.

Another variant of a DOF transcription factor nucleic acid/gene is a nucleic acid capable of hybridising under reduced stringency conditions, preferably under stringent conditions, with a DOF transcription factor nucleic acid/gene as hereinbefore defined, which hybridising sequence encodes a polypeptide comprising feature (i) as follows and additionally either feature (ii) or (iii) as follow:

(i) in increasing order of preference at least 60%, 65%, 70%, 75%, 80%, 85%, 90% or 95% sequence identity to either the DOF domain represented by SEQ ID NO: 200 or SEQ ID NO: 228; and (ii) in increasing order of preference at least 70%, 75%, 80%, 85%, 90% or 95% sequence identity to the DOF domain represented by SEQ ID NO: 200; or (iii) Motif I: KALKKPDKILP (SEQ ID NO: 229) with no changes; or with one or more conservative change at any position; or with one, two or three non-conservative change(s) at any position; and/or Motif II: DDPGIKLFGKTIPF (SEQ ID NO: 230) with no changes; or with one or more conservative change at any position; or with one, two or three non-conservative change(s) at any position.

Additionally feature (iii) above may comprise any one, any two or all three of the following motifs:

Motif III: SPTLGKHSRDE (SEQ ID NO: 231) with no changes; or with one or more conservative change at any position; or with one, two or three non-conservative change(s) at any position; and/or Motif IV: LQANPAALSRSQNFQE (SEQ ID NO: 232) with no changes; or with one or more conservative change at any position; or with one, two or three non-conservative change(s) at any position; and/or.

Motif V: KGEGCLWVPKTLRIDDPDEMKSSIWrrLGIK (SEQ ID NO: 233) with no changes; or with one or more conservative change at any position; or with one, two, three, four or five non-conservative change(s) at any position.

Preferably, the hybridising sequence encoding DOF transcription factor polypeptides comprising features (i) and (ii) as defined hereinabove is a sequence capable of hybridising to a nucleic acid as represented by any one of: SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219 and SEQ ID NO: 221.

Preferably, the hybridising sequence encoding DOF transcription factor polypeptides comprising features (i) and (iii) as defined hereinabove is a sequence capable of hybridising to a nucleic acid as represented by any one of: SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252 and SEQ ID NO: 254.

The term "hybridisation" is as defined herein in the "Definitions" section.

The DOF transcription factor polypeptide may be encoded by an alternative splice variant. The term "alternative splice variant" is as defined in the "Definitions" section herein.

Preferred splice variants are splice variants of the nucleic acid encoding a polypeptide comprising feature (i) as follows and additionally either feature (ii) or (iii) as follow:
(i) in increasing order of preference at least 60%, 65%, 70%, 75%, 80%, 85%, 90% or 95% sequence identity to either the DOF domain represented by SEQ ID NO: 200 or SEQ ID NO: 228; and
(ii) in increasing order of preference at least 70%, 75%, 80%, 85%, 90% or 95% sequence identity to the DOF domain represented by SEQ ID NO: 200; or
(iii) Motif I: KALKKPDKILP (SEQ ID NO: 229) with no changes; or with one or more conservative change at any position; or with one, two or three non-conservative change(s) at any position; and/or
Motif II: DDPGIKLFGKTIPF (SEQ ID NO: 230) with no changes; or with one or more conservative change at any position; or with one, two or three non-conservative change(s) at any position.

Preferred splice variants of nucleic acids encoding DOF transcription factor polypeptides comprising features (i) and (ii) as defined hereinabove are splice variants of a nucleic acid as represented by any one of: SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219 and SEQ ID NO: 221.

Preferred splice variants of nucleic acids encoding DOF transcription factor polypeptides comprising features (i) and (iii) as defined hereinabove are preferably splice variants of a nucleic acid as represented by any one of: SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252 and SEQ ID NO: 254.

The DOF transcription factor polypeptide may also be encoded by an allelic variant, which are also defined in the "Definitions" section herein.

Preferred allelic variants are allelic variants of the nucleic acid encoding a polypeptide comprising feature (i) as follows and additionally either feature (ii) or (iii) as follow:
(i) in increasing order of preference at least 60%, 65%, 70%, 75%, 80%, 85%, 90% or 95% sequence identity to either the DOF domain represented by SEQ ID NO: 200 or SEQ ID NO: 228; and
(ii) in increasing order of preference at least 70%, 75%, 80%, 85%, 90% or 95% sequence identity to the DOF domain represented by SEQ ID NO: 200; or
(iii) Motif I: KALKKPDKILP (SEQ ID NO: 229) with no changes; or with one or more conservative change at any position; or with one, two or three non-conservative change(s) at any position; and/or
Motif II: DDPGIKLFGKTIPF (SEQ ID NO: 230) with no changes; or with one or more conservative change at any position; or with one, two or three non-conservative change(s) at any position.

Preferred allelic variants of nucleic acids encoding DOF transcription factor polypeptides comprising features (i) and (ii) as defined hereinabove are splice variants of a nucleic acid as represented by any one of: SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219 and SEQ ID NO: 221.

Preferred allelic variants of nucleic acids encoding DOF transcription factor polypeptides comprising features (i) and (iii) as defined hereinabove are preferably portions of a nucleic acid as represented by any one of. SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252 and SEQ ID NO: 254.

Further variants of Nucleic acids encoding DOF transcription factor polypeptides as defined hereinabove may be generated using, for example, site-directed mutagenesis as defined in the "Definitions" section herein.

Directed evolution (or gene shuffling) may also be used to generate variants of nucleic acids encoding DOF transcription factor polypeptides. See "definitions" section.

DOF transcription factor polypeptides are plant-specific. Nucleic acids encoding the same may be derived from any natural or artificial source. The nucleic acid or variant thereof may be modified from its native form in composition and/or genomic environment through deliberate human manipulation. Preferably the DOF transcription factor nucleic acid or variant thereof is from a dicotyledonous plant, further preferably from the family Brassicaceae, more preferably the nucleic acid is from *Arabidopsis thaliana*.

The expression of a nucleic acid encoding a DOF transcription factor polypeptide may be increased by introducing a genetic modification (preferably in the locus of a DOF transcription factor gene). The locus of a gene as defined herein is taken to mean a genomic region, which includes the gene of interest and 10 KB up- or downstream of the coding region.

The genetic modification may be introduced, for example, by any one (or more) of the following methods: T-DNA activation, TILLING and homologous recombination or by introducing and expressing in a plant a nucleic acid encoding a DOF transcription factor polypeptide. The methods of T-DNA activation, TILLING and homologous recombination are as defined in the "Definitions" section herein. Following introduction of the genetic modification, there follows an optional step of selecting for increased expression of a nucleic acid encoding a DOF transcription factor polypeptide, which increased expression gives plants having increased yield.

T-DNA activation and TILLING are examples of technologies that enable the generation of novel alleles and DOF transcription factor variants.

A preferred method for introducing a genetic modification (which in this case need not be in the locus of a DOF transcription factor gene) is to introduce and express in a plant a nucleic acid encoding a DOF transcription factor polypeptide as defined hereinabove. The nucleic acid to be introduced into a plant may be a full-length nucleic acid or may be a portion or a hybridising sequence or another nucleic acid variant as hereinbefore defined.

The methods of the invention rely on increased expression of a nucleic acid encoding a DOF transcription factor polypeptide. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding a DOF transcription factor polypeptide. For example, endogenous promoters may be altered in vivo by mutation, deletion, and/or substitution (see, Kmiec, U.S. Pat. No. 5,565,350; Zarling et al., PCT/US93/03868), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

The invention also provides genetic constructs and vectors to facilitate introduction and/or expression of the nucleotide sequences useful in the methods according to the invention.

Therefore, there is provided a gene construct comprising:
(i) A nucleic acid or variant thereof encoding a DOF transcription factor polypeptide as defined hereinabove;
(ii) One or more control sequences capable of driving expression of the nucleic acid sequence of (i); and optionally
(iii) A transcription termination sequence.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of Interest in the transformed cells. The Invention therefore provides use of a gene construct as defined hereinabove in the methods of the invention.

Plants are transformed with a vector comprising the sequence of interest (i.e., a nucleic acid encoding a DOF transcription factor polypeptide). The sequence of interest is operably linked to one or more control sequences (at least to a promoter). The terms "regulatory element", "control sequence" and "promoter" are all used interchangeably herein and are defined in the "Definitions" section herein.

Advantageously, any type of promoter, whether natural or synthetic, may be used to drive expression of the nucleic acid sequence.

According to one preferred feature of the invention, the DOF transcription factor nucleic acid or variant thereof is operably linked to a constitutive promoter as defined in the "Definitions" section herein. The constitutive promoter is preferably a GOS2 promoter, more preferably the constitutive promoter is a rice GOS2 promoter, further preferably the constitutive promoter is represented by a nucleic acid sequence substantially similar to SEQ ID NO: 225, most preferably the constitutive promoter is as represented by SEQ ID NO: 225. Preferred is the use of a constitutive promoter to drive expression of a nucleic acid encoding a DOF transcription factor polypeptide comprising features (i) and (ii) as defined hereinabove, i.e. at least 60% sequence identity to either the DOF domain represented by SEQ ID NO: 200 or SEQ ID NO: 228; and at least 70% sequence identity to the DOF domain represented by SEQ ID NO: 200.

It should be clear that the applicability of the present invention is not restricted to the DOF transcription factor nucleic acid represented by SEQ ID NO: 198, nor is the applicability of the invention restricted to expression of a DOF transcription factor nucleic acid when driven by a GOS2 promoter. Examples of other constitutive promoters which may also be used perform the methods of the invention are shown in Table 3 in the "Definitions" section herein.

According to another preferred feature of the invention, the nucleic acid encoding a DOF transcription factor polypeptide is operably linked to a seed-specific promoter, i.e. a promoter that is expressed predominantly in seed tissue, but which may have residual expression elsewhere in the plant due to leaky promoter expression. Further preferably, the seed-specific promoter is isolated from a gene encoding a seed-storage protein, especially an endosperm-specific promoter. Most preferably the endosperm-specific promoter is isolated from a prolamin gene, such as a rice prolamin RP6 (Wen et al., (1993) Plant Physiol 101(3): 1115-6) promoter as represented by SEQ ID NO: 258, or a promoter of similar strength and/or a promoter with a similar expression pattern as the rice prolamin promoter. Similar strength and/or similar expression pattern may be analysed, for example, by coupling the promoters to a reporter gene and checking the function of the reporter gene in tissues of the plant. One well-known reporter gene is beta-glucuronidase and the calorimetric GUS stain used to visualize betaglucuronidase activity in plant tissue. The prolamin promoter shows strong expression in the endosperm, with leakiness in meristem, more specifically the shoot meristem and/or discrimination centre in the meristem.

Preferred according to the invention is the use of a seed-specific promoter, especially an endosperm-specific promoter, to drive expression of a nucleic acid encoding a DOF transcription factor polypeptide comprising features (i) and (iii) as defined hereinabove, i.e. at least 60% sequence identity to either the DOF domain represented by SEQ ID NO: 200 or SEQ ID NO: 228; and Motif I and/or Motif II.

It should be clear that the applicability of the present invention is not restricted to the DOF transcription factor nucleic acid represented by SEQ ID NO: 226, nor is the applicability of the invention restricted to expression of a DOF transcription factor nucleic acid when driven by a prolamin promoter.

Examples of seed-specific promoters are presented in Table 7 in the "Definitions" section herein, which promoters or derivatives thereof are useful in performing the methods of the present invention.

Optionally, one or more terminator sequences may also be used in the construct introduced into a plant. The term "terminator" is as defined in the "Definitions" section herein.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene as defined herein in the "Definitions" section.

The present invention also encompasses plants obtainable by the methods according to the present invention. The present invention therefore provides plants, plant parts or plant cells thereof obtainable by the method according to the present invention, which plants or parts or cells thereof comprise a nucleic acid transgene (or variant thereof as define above) encoding a DOF transcription factor polypeptide.

The invention also provides a method for the production of transgenic plants having increased yield relative to suitable control plants, comprising introduction and expression in a plant of a nucleic acid or a variant thereof encoding a DOF transcription factor polypeptide.

More specifically, the present invention provides a method for the production of transgenic plants having increased yield which method comprises:
  (i) introducing and expressing in a plant, plant part or plant cell a nucleic acid or variant thereof encoding a DOF transcription factor polypeptide; and
  (ii) cultivating the plant cell under conditions promoting plant growth and development.

The nucleic acid may be introduced directly into a plant cell or into the plant itself (including introduction into a tissue, organ or any other part of a plant). According to a preferred feature of the present invention, the nucleic acid is preferably introduced into a plant by transformation.

The term "transformation" is as defined herein in the "Definitions" section.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid or variant thereof encoding a DOF transcription factor polypeptide. Preferred host cells according to the invention are plant cells.

The invention also extends to harvestable parts of a plant such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

The present invention also encompasses use of nucleic acids or variants thereof encoding DOF transcription factor polypeptides and use of DOF transcription factor polypeptides in increasing plant yield as defined hereinabove in the methods of the invention.

Nucleic acids or variants thereof encoding DOF transcription factor polypeptides, or DOF transcription factor polypeptides, may find use in breeding programmes in which a DNA marker is identified which may be genetically linked to a DOF transcription factor gene or variant thereof. The nucleic acids/genes or variants thereof, or the DOF transcription factor polypeptides may be used to define a molecular marker. This DNA or protein marker may then be used in breeding programmes to select plants having increased yield as defined hereinabove in the methods of the invention.

Allelic variants of a DOF transcription factor nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

A nucleic acid or variant thereof encoding a DOF transcription factor polypeptide may also be used as probes for genetically and physically mapping the genes that they are a part of, and as markers for traits linked to those genes. Such information may be useful in plant breeding in order to develop lines with desired phenotypes. Such use of DOF transcription factor nucleic acids or variants thereof requires only a nucleic acid sequence of at least 15 nucleotides in length. The DOF transcription factor nucleic acids or variants thereof may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the DOF transcription factor nucleic acids or variants thereof. The resulting banding patterns may then be subjected to genetic analyses using computer programs such as Map-Maker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the DOF transcription factor nucleic acid or variant thereof in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favor use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having increased yield, as described hereinbefore. This increased yield may also be combined with other economically advantageous traits, such as further yield-enhancing traits, tolerance to other abiotic and biotic stresses, traits modifying various architectural features and/or biochemical and/or physiological features.

Detailed Description CKI

Reference herein to a preferential "reduction" in expression of an endogenous CKI gene in endosperm tissue of a plant is taken to mean a reduction or substantial elimination of expression of an endogenous CKI gene (in endosperm tissue) relative to endogenous CKI gene expression levels found in endosperm tissue of wild type plants. This reduction or substantial elimination of endogenous CKI gene expression may result in reduced or substantially eliminated CKI protein levels and/or activity in endosperm tissue of a plant.

Reference herein to an "endogenous" CKI gene not only refers to CKI genes as found in a plant in its natural form (i.e., without there being any human intervention), but also refers to isolated CKI genes subsequently introduced into a plant. For example, a transgenic plant containing a CKI transgene may encounter a reduction or substantial elimination of the CKI transgene and/or a reduction or substantial elimination of an endogenous CKI gene (in endosperm tissue).

This reduction (or substantial elimination) of endogenous CKI gene expression may be achieved using any one or more of several well-known gene silencing methods. "Gene silencing" or "downregulation" of expression, as used herein, refers to a reduction or the substantial elimination of CKI gene expression and/or CKI polypeptide levels and/or CKI polypeptide activity.

One such method for reduction or substantial elimination of endogenous CKI gene expression is RNA-mediated downregulation of gene expression (RNA silencing). Silencing in this case is triggered in a plant by a double stranded RNA molecule (dsRNA) that is substantially homologous to a target CKI gene. This dsRNA is further processed by the plant into about 21 to about 26 nucleotides called short interfering RNAs (siRNAs). The siRNAs are incorporated into an RNA-induced silencing complex (RISC) that cleaves the mRNA of a CKI target gene, thereby reducing or substantially eliminating the number of CKI mRNAs to be translated into a CKI protein.

One example of an RNA silencing method involves the introduction of coding sequences or parts thereof in a sense orientation into a plant. "Sense orientation" refers to DNA that is homologous to an mRNA transcript thereof. Introduced into a plant would therefore be at least an additional copy (in full or in part) of a CKI gene already present in the host plant. The additional gene, or part thereof, will silence an endogenous CKI gene, giving rise to a phenomenon known as co-suppression. The reduction of CKI gene expression will be more pronounced if several additional copies are introduced into the plant, as there is a positive correlation between high transcript levels and the triggering of co-suppression.

Another example of an RNA silencing method involves the use of antisense CKI nucleic acid sequences. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire CKI coding strand or only to a portion thereof. The antisense nucleic acid molecule may be antisense to a "coding region" or antisense to a "non-coding region" of the coding strand of a nucleotide sequence encoding CKI. The term "coding region" refers to the region of the nucleotide sequence comprising codons that are translated into amino acid residues. The term "non-coding region" refers to 5' and 3' sequences that flank the coding region that are not translated into amino acids (I.e., also referred to as 5' and 3' untranslated regions).

Antisense nucleic acids can be designed according to the rules of Watson and Crick base pairing. The antisense nucleic acid molecule may be complementary to the entire coding region of CKI mRNA, but is preferably an oligonucleotide which is antisense to only a portion of the coding or non-coding region of CKI mRNA. For example, the antisense oligonucleotide may be complementary to the region surrounding the translation start site of CKI mRNA. The length of a suitable antisense oligonucleotide would be known in the art and may be start from about 20 nucleotides in length or less. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid are well known in the art.

Other known nucleotide modifications include methylation, cyclization and 'caps' and substitution of one or more of the naturally occurring nucleotides with an analog such as inosine. Other modifications of nucleotides are well known to a person skilled in the art.

Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic add of interest, described further in the following subsection). Preferably, production of antisense nucleic acids in plants occurs by means of a stably integrated transgene comprising a promoter operative for preferential expression in endosperm tissue plants, an antisense oligonucleotide, and a terminator.

A preferred method for reduction or substantial elimination of endogenous CKI gene expression via RNA silencing is by using an expression vector into which a CKI gene or fragment thereof has been cloned as an inverted repeat (in part or completely), separated by a spacer (non-coding DNA). After transcription of the inverted repeat, a chimeric CKI RNA with a self-complementary structure is formed (partial or complete). This double-stranded RNA structure is referred to as the hairpin RNA (hpRNA). The hpRNA is processed by the plant into siRNAs that are incorporated into a RISC. The RISC further cleaves the mRNA of a CKI target gene, thereby reducing or substantially eliminating the number of CKI mRNAs to be translated into a CKI protein. See for example, Grierson et al. (1998) WO 98/53083; Waterhouse et al. (1999) WO 99/53050).

The nucleic acid molecules used for silencing in the methods of the invention (whether introduced into a plant or generated in situ) hybridize with or bind to cellular mRNA and/or genomic DNA encoding an CKI protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Antisense nucleic acid molecules may be introduced into a plant by transformation or direct injection at a specific tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein.

According to a further aspect, the antisense nucleic acid is an α-anomeric nucleic acid molecule. An α-anomeric nucleic acid molecule forms specific double-stranded hybrids with complementary RNA in which, contrary to the usual β-units, the strands run parallel to each other (Gaultier et al., (1987) *Nucleic Acids. Res.* 15:6625-6641). The antisense nucleic acid molecule may also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave CKI mRNA transcripts to thereby inhibit translation of CKI mRNA. A ribozyme having specificity for a CKI-encoding nucleic acid can be designed based upon the nucleotide sequence of a CKI cDNA. For example, a derivative of a Tetrahymena L-19 IVS RNA can be constructed in which the nucleotide sequence of the active site is complementary to the nucleotide sequence to be cleaved in an CKI-encoding mRNA. See, e.g., Cech et al. U.S. Pat. No. 4,987,071; and Cech et at. U.S. Pat. No. 5,116,742. Alternatively, CKI mRNA can be used to select a catalytic RNA having a specific ribonuclease activity from a pool of RNA molecules. See, e.g., Bartel, D. and Szostak, J. W. (1993) *Science* 261: 1411-1418. The use of ribozymes for gene silencing in plants is known in the art (e.g., Atkins et al. (1994) WO 94/00012; Lenne et at. (1995) WO 95/03404; Lutziger et al. (2000) WO 00/00619; Prinsen et al. (1997) WO 97113865 and Scott et al. (1997) WO 97/38116).

Gene silencing may also be achieved by insertion mutagenesis (for example, T-DNA insertion or transposon insertion) or by gene silencing strategies as described by, among others, Angell and Baulcombe 1998 (Amplicon VIGS WO 98/36083); Baulcombe (WO 99/15682).

Gene silencing may also occur if there is a mutation on the endogenous CKI gene and/or a mutation on an isolated CKI gene subsequently introduced into a plant. The reduction or substantial elimination of CKI expression may be caused by a non-functional CKI. CKI binds to both CDK and cyclins (Verkest et at., (2005) Plant Cell 17: 1723-1736). For example, mutation of the cyclin binding site within a CKI, provides for a CKI that can still bind to a CDK but that cannot inhibit the active CDK-cyclin complex.

A further approach to gene silencing is by targeting nucleotide sequences complementary to the regulatory region of the CKI (e.g., the CKI promoter and/or enhancers) to form triple helical structures that prevent transcription of the CKI gene in target cells. See Helene, C. (1991) *Anticancer Drug Des.* 6(6): 56984; Helene, C. et al. (1992) *Ann. N.Y. Acad. Sci.* 660:27-36; and Maher, L. J. (1992) *Bioassays* 14(12): 807-15.

Described above are examples of various methods for gene silencing (for the reduction or substantial elimination of endogenous CKI gene expression. The methods of the invention rely on the preferential reduction of expression of an endogenous CKI gene in endosperm tissue of a plant. A person skilled in the art would readily be able to adapt the aforementioned methods for silencing so as to achieve preferential gene silencing in endosperm tissue, through the use of an appropriate promoter, for example.

It should be noted that the essence of the present invention resides in the advantageous and surprising results found upon reduction or substantial elimination of endogenous CKI gene expression in endosperm tissue of a plant, and is not limited to any particular method for such reduction or substantial elimination of endogenous CKI gene expression. Other such methods will be well known to the skilled man.

For optimal performance, the gene silencing techniques used for the reduction or substantial elimination of endogenous CKI gene expression requires the use of CKI nucleic acid sequences from monocotyledonous plants for transformation into monocotyledonous plants. Preferably, a CKI nucleic acid from any given plant species is introduced into that same species. For example, a CKI nucleic acid from rice (be it a full length CKI sequence or a fragment) is transformed into a rice plant. The CKI nucleic acid need not be introduced into the same plant variety.

Reference herein to a "CKI gene" or a CKI nucleic acid" is taken to mean a polymeric form of a deoxyribonucleotide or a ribonucleotide polymer of any length, either double- or single-stranded, or analogues thereof, that have the essential characteristic of a natural ribonucleotide in that they can hybridise to nucleic acids in a manner similar to naturally occurring polynucleotides. A "CKI gene" or a CKI nucleic acid" refers to a sufficient length of substantially contiguous nucleotides of a CKI-encoding gene to perform gene silencing; this may be as little as 20 or fewer nucleotides. A gene encoding a (functional) protein is not a requirement for the various methods discussed above for the reduction or substantial elimination of expression of an endogenous CKI gene.

The methods of the invention may be performed using a sufficient length of substantially contiguous nucleotides of a CKI gene/nucleic acid, which may consist of 20 or fewer nucleotides, which may be from any part of the CKI gene/nucleic acid, such as the 3' end of the coding region that is well conserved amongst the CKI gene family.

CKI genes are well known in the art and useful in the methods of the invention are substantially contiguous nucleotides of any of the plant CKI genes/nucleic acid described in published International patent application WO 2005/007829 in the name of Monsanto Technology LLC and Published International patent applications, WO 02/28893 and WO 99114331 in the name of CropDesign N.V, which CKI gene/nucleotide sequences are incorporated herein as if fully set forth.

Other CKI gene/nucleic acid sequences may also be used in the methods of the invention, and may readily be identified by a person skilled in the art. CKI polypeptides may be identified by the presence of one or more of several well-known features (see below). Upon identification of a CKI polypeptide, a person skilled in the art could easily derive, using routine techniques, the corresponding encoding nucleic acid sequence and use a sufficient length of contiguous nucleotides of the same to perform any one or more of the gene silencing methods described above (for the reduction or substantial elimination of an endogenous CKI gene expression, in the endosperm).

One distinguishing feature of a CKI polypeptide is a C-terminal region comprising between about 40 and about 55 highly conserved amino acids. As a guide, polypeptides comprising in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity to the C-terminal region of a CKI as represented by SEQ ID NO: 262 may be taken to be CKI homologues. A person skilled in the art may easily derive the corresponding nucleic acid encoding such homologues, and use a sufficient length of contiguous nucleotides of the same to perform any one or more of the gene silencing methods described above (for the reduction or substantial elimination of an endogenous CKI gene expression).

A person skilled in the art will be well aware of what is meant by a "C-terminal" of a protein; for the purposes of this application, the C-terminal region of a CKI may be taken to be the second half (from N-terminal to C-terminal) of a full length CKI polypeptide.

Homologues, as defined above, i.e. polypeptides comprising at least 50% identity to the C-terminal region of a CKI as represented by SEQ ID NO: 262, may readily be identified using routine techniques well known in the art, such as by sequence alignment. Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the alignment of two complete sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information. Homologous sequences may readily be identified using, for example, the ClustalW multiple sequence alignment algorithm (version 1.83) available at http://clustalw.genome.jp/sit-bin/nph-ClustalW, with the default pairwise alignment parameters, and a scoring method in percentage. Minor manual editing may be performed to optimise alignment between conserved motifs (see below), as would be apparent to a person skilled in the art.

Plant CKI polypeptides may also be identified by the presence of certain conserved motifs (see Table 12 below). The presence of these conserved motifs may be identified using methods for the alignment of sequences for comparison as described hereinabove. In some instances, the default parameters may be adjusted to modify the stringency of the search. For example using BLAST, the statistical significance threshold (called "expect" value) for reporting matches against database sequences may be increased to show less stringent matches. This way, short nearly exact matches may be identified. Upon identification of a CKI polypeptide by the presence of these motifs, a person skilled in the art may easily derive the corresponding nucleic acid encoding the polypeptide comprising the relevant motifs, and use a sufficient length of contiguous nucleotides of the same to perform any one or more of the gene silencing methods described above (for the reduction or substantial elimination of an endogenous CKI gene expression).

Typically, the presence of at least one of the motifs 1 to 5 (for example motif 2 is particularly well conserved) should be sufficient to identify any query sequence as a CKI, however for increased certainty, the presence of at least Motifs 1, 2 and 3 is preferred. The consensus sequence provided is based on the sequences displayed in Table 12 below. A person skilled in the art would be well aware that the consensus sequence may vary somewhat if further or different sequences were used for comparison.

Motif 1: FXXKYNFD (SEQ ID NO: 261), wherein X is any amino acid
Motif 2: [P/L]LXGRYEW (SEQ ID NO: 262), wherein X is any amino acid and [P/L] means that either a proline or a leucine appear at the indicated position
Motif 3: EXE[D/E]FFXXXE (SEQ ID NO: 263), wherein X is any amino acid and [D/E] means that either an aspartate or a glutamate appear at the indicated position
Motif 4: YXQLRSRR (SEQ ID NO: 264), wherein X is any amino acid
Motif 5: MGKY[M/I][K/R]KX[(KR] (SEQ ID NO: 265), wherein X is any amino acid, [M/I] means that either a methionine or an isoleucine appear at the indicated position, and [K/R] means that either a lysine or an arginine appear at the indicated position
Motif 6: SXGVRTRA (SEQ ID NO: 266), wherein X is any amino acid Motifs 1, 2, and 3 are typically found in the carboxyl-terminal region of plant CKI proteins. This region is believed to be involved in the interaction of CKIs with both CDKs and cyclins (Chen et al. (1996) *Mol. Cell Biol* 16, 46734682, Matsuoka et al. (1995) *Genes Dev.* 9, 650-662, and Nakayama and Nakayama (1998) Bioessays 20, 1020-1029). Motifs 4, 5, and 6 are typically found in the amino-terminal region of plant CKI proteins.

CKI proteins from monocot plants, particularly rice, are characterized by extensive α-helical stretches especially between motifs 5 and 6 and between motifs 6 and 4.

TABLE 12

Conserved motifs in plant CKI proteins. CKI1 to CKI7 denote *Arabidopsis thaliana* CKIs. Os: *Oryza sativa*, Zm: *Zea mays*, Sb: *Sorghum bicolor*

| | Motif 1 | Motif 2 | Motif 3 | Motif 4 | Motif 5 | Motif 6 |
|---|---|---|---|---|---|---|
| Alfalfa CKI | 198-FMEKYNFD | 211-PLPGRYET | 182-EFEEFCAKHE | 74-YLQLRNRR | 1-MGKYMKKLK | 45-SDGVRTRA |
| CKI1 AC003040 | 167-FKKKYNFD | 180-PLEGRYEW | 151-EIEDFFVEAE | 20-YMQLRSRR | | |
| CKI2 AL132979 | 183-CSMKYNFD | 197-LGGGRYEW | 164-ELEDFFQVAE | | | |
| CKI3 AB012242 | 197-FMEKYNFD | 210-PLSGRYEW | 181-EMEEFFAYAE | 58-YLQLRSRR | 1-MGKYMKKSK | 26-SPGVRTRA |
| CKI4 AC003974 | 264-FIEKYNFD | 277-PLPGRFEW | 248-EMDEFFSGAE | 102-YLQLRSRR | 1-MGKYIRKSK | 44-SLGVLTRA |
| CKI5 AB028609 | 164-FIQKYNFD | 177-PLPGRYEW | 148-EIEDFFASAE | 54-YLQLRSRR | 1-MGKYIKKSK | 24-ALGFRTRA |
| CKI6 AP000419 | 173-FIEKYNFD | 186-PLEGRYKW | 155-EIEDLFSELE | | | |
| CKI7 AC011807 | 170-FTEKYNYD | 183-PLEGRYQW | 154-ELDDFFSAAE | | | |
| Chenopodium CKI AJ002173 | 171-FSEKYNFD | 184-PLKGRYDW | 155-EIEEFFAVAE | 25-IPQLRSRR | | |
| OsCKI2 | 233-FAAKYNFD | 247-LDAGRFEW | 217-EIEAFFAAAE | 75-YLQLRSRM | 1-MGKYMRKFR | 24-VVGVRTRS |
| OsCKI1 OsCKI3 | ----YNYD FAEKY--- | PLQGRYEW | EIEAFFAAAE | | | |
| OsCKI4 | 170-FIDKYNFD | 183-PLPGRFEW | 154-ELEAFFAAEE | 48-YLELRSRR | 1-MGKYMRKAK | 28-PLGVRTRA |
| OsCKI5 | 196-FAAKYNFD | 209-PLDAGGAGRFEW | 180-EIEEFLAAAE | 63-YLRLRSRR | 1-MGKKKKRDG | 20-VGGVRTRA |
| ZmCKI1 | FASKYNFD | LDAGRFEW | EIQEFFAAAE | | | |
| ZmCKI2 | FIDKYNFD | PLPGRFEW | EMNEYFAAEQ | | | |
| SbCKI | FAEAYNYD | PLEGRFEW | EIEAFFAAAE | | | |
| CONSENSUS | FX$_2$KYNFD | [P/L]LXGR[Y/F]EW | EXE[D/E]FFX$_3$E | YXQLRSRR | MGKY[M/I][K/R]KX[K/R] | SXGVRTRA |

In addition to the abovementioned features, a CKI protein may also comprise any one or more of the following: a Cy-box, a nuclear localization sequence and a PEST sequence.

The term "Cy-Box" refers to an amino acid sequence of about 5 amino acid residues in length having the consensus sequence RXHuF, wherein X is any amino acid and Hu is a hydrophobic uncharged amino acid, such as M, I, L or V. Cy-boxes are typically involved in the interaction of CKIs with cyclins.

A "nuclear localization sequence" refers to an amino acid sequence of about 4-20 amino acid residues in length, which serves to direct a protein to the nucleus. Typically, the nuclear localization sequence is rich in basic amino acids, such as arginine (R) and lysine (K). Nuclear localization signals are described in, for example, Gorlich D. (1998) EMBO 5.17: 2721-7. The Os CKI4 protein comprises multiple nuclear localization sequences.

A "PEST sequence" refers to an amino acid sequence which is enriched in the amino acid residues proline (P), glutamate (E), serine (S) and threonine M and which is present in proteins with a high proteolytic turnover rate. PEST sequences are described in, for example, Rogers et al., (1986) Science 234, 364-368.

The various structural domains in a CKI protein may be identified using specialised databases e.g. SMART (Schultz et al. (1998) Proc. Natl. Acad. Sci. USA 95, 5857-5864; Letunic et al. (2002) Nucleic Acids Res 30, 242-244; http://smart.embl-heidelberg.deI), InterPro (Mulder et al., (2003) Nucl. Acids. Res. 31, 315-318; http://www.ebi.ac.ukfinterpro/), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAIPress, Menlo Park; Hulo et al., Nucl. Acids. Res. 32:D134-D137, (2004), http://www.expasy.org/prosite/) or Pfam (Bateman et al., Nucleic Acids Research 30(1): 276-280 (2002), http://www.sanger.ac.uk/Software/Pfam/).

Furthermore, a CKI protein may also be identifiable by its ability to inhibit the activity of a Cyclin Dependent Kinase (CDK), e.g., a plant CDK. CDKs are a group of serine/threonine kinases which regulate the progression of the cell cycle in eukaryotes, e.g., plants. CDKs are typically complexed with cyclins forming an enzyme complex, CDK being the catalytic subunit and cyclin being the regulatory subunit of the enzyme complex (VWang, H. (1997) *The Plant Journal* 15(4): 501-510).

Therefore upon identification of a CKI polypeptide using one or several of the features described above, a person skilled in the art may easily derive the corresponding nucleic acid encoding the polypeptide, and use a sufficient length of substantially contiguous nucleotides of the same to perform any one or more of the gene silencing methods described above (for the reduction or substantial elimination of an endogenous CKI gene expression).

Preferred for use in the methods of the invention is a sufficient length of substantially contiguous nucleotides of SEQ ID NO: 267 (OsCKI4), or the use of a sufficient length of substantially contiguous nucleotides of a nucleic acid sequence encoding an orthologue or paralogue of OsCKI4 (SEQ ID NO: 267). Examples of such orthologues and paralogues of OsCKI4 are provided in Table 13 below.

Orthologues and paralogoues are homologues that encompass evolutionary concepts used to describe ancestral relationships of genes. Paralogues are genes within the same species that have originated through duplication of an ancestral gene and orthologues are genes from different organisms that have originated through speciation.

Orthologues in, for example, monocot plant species may easily be found by performing a so-called reciprocal blast search. This may be done by a first blast involving blasting a query sequence (for example, SEQ ID NO: 267 or SEQ ID NO: 268) against any sequence database, such as the publicly available NCBI database which may be found at: http://www.ncbi.nlm.nih.gov. BLASTN or TBLASTX (using standard default values) may be used when starting from a nucleotide sequence and BLASTP or TBLASTN (using standard default values) may be used when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 267 or SEQ ID NO: 268 the second blast would therefore be against rice sequences). The results of the first and second BLASTs are then compared. A paralogue is identified if a high-ranking hit from the second blast is from the same species as from which the query sequence is derived; an orthologue is identified if a high-ranking hit is not from the same species as from which the query sequence is derived. High-ranking hits are those having a low E-value. The lower the E-value, the more significant the score (or in other words the lower the chance that the hit was found by chance). Computation of the E-value is well known in the art. In the case of large families, ClustalW may be used, followed by a neighbour joining tree, to help visualize clustering of related genes and to identify orthologues and paralogues.

TABLE 13

Orthologues and Paralogues of OsCKI4 (SEQ ID NO: 267 and 268)

| Name | NCBI | SEQ ID nucleic acid sequence | SEQ ID polypeptide sequence | Source |
|---|---|---|---|---|
| Zeama_CKI4 like | AY986792 | 269 | 270 | Zea mays |
| Triae_CKI4 like | Contig of BG908519.1 and CA640135.1 | 271 | 272 | Triticum aestivum |
| Orysa_CKI3 | AK064723.1 | 273 | 274 | Oryza sativa |
| Zeama_CKI3 like | DV174570.1 | 275 | 276 | Zea mays |
| Sorbi_CKI3 like | contig of CN152732.1 and CD224882.1 | 277 | 278 | Sorghum bicolor |
| Sacof_CKI4 like | CO373621.1 | 279 | 280 | Saccharum officinarum |

The source of the substantially contiguous nucleotides of a CKI gene/nucleic acid may be any plant source or artificial source. For optimal performance, the gene silencing techniques used for the reduction or substantial elimination of endogenous CKI gene expression requires the use of CKI sequences from monocotyledonous plants for transformation into monocotyledonous plants. Preferably, CKI sequences from the family Poaceae are transformed into plants of the family Poaceae. Further preferably, a CKI nucleic acid from rice (be it a full length CKI sequence or a fragment) is transformed into a rice plant. The CKI nucleic acid need not be introduced into the same plant variety. Most preferably, the CKI nucleic acid from rice is a sufficient length of substantially contiguous nucleotides of SEQ ID NO: 267 (OsCKI4) or a sufficient length of substantially contiguous nucleotides of a nucleic acid sequence encoding an orthologue or paralogue of OsCKI4 (SEQ ID NO: 267). As mentioned above, a person skilled in the art would be well aware of what would constitute a sufficient length of substantially contiguous nucleotides to perform any of the gene silencing methods defined hereinabove, this may be as little as 20 or fewer substantially contiguous nucleotides in some cases.

The invention also provides genetic constructs and vectors to facilitate introduction and/or expression of the nucleotide sequences useful in the methods according to the invention.

Therefore, there is provided a gene construct comprising one or more control sequences capable of preferentially driving expression of a sense and/or antisense CKI nucleic acid sequence in plant endosperm tissue so as to silence an endogenous CKI gene in endosperm tissue of a plant; and optionally a transcription termination sequence.

A preferred construct for gene silencing is one comprising an inverted repeat of a CKI gene or fragment thereof, preferably capable of forming a hairpin structure, which inverted repeat is under the control of an endosperm-specific promoter.

Constructs useful in the methods according to the present invention may be constructed using recombinant DNA technology well known to persons skilled in the art. The gene constructs may be inserted into vectors, which may be commercially available, suitable for transforming into plants and suitable for expression of the gene of interest in the transformed cells. The invention therefore provides use of a gene construct as defined hereinabove in the methods of the invention.

The sequence of interest is operably linked to one or more control sequences (at least to a promoter) capable of preferentially increasing expression in endosperm tissue of a plant. The terms "regulatory element", "control sequence" and "promoter" are all used interchangeably herein and are defined in the "Definitions" section herein.

An endosperm-specific promoter refers to any promoter able to preferentially drive expression of the gene of interest in endosperm tissue. Reference herein to "preferentially" driving expression in endosperm tissue is taken to mean driving expression of any sequence operably linked thereto in endosperm tissue substantially to the exclusion of driving expression elsewhere in the plant, apart from any residual expression due to leaky promoter expression. For example, the prolamin promoter shows strong expression in the endosperm, with leakiness in meristem, more specifically the shoot meristem and/or discrimination centre in the meristem.

Preferably, the endosperm-specific promoter is a promoter isolated from a prolamin gene, such as a rice prolamin RP6 (Wen et al., (1993) Plant Physiol 101(3): 1115-6) promoter as represented by SEQ ID NO: 281 or a promoter of similar strength and/or a promoter with a similar expression pattern as the rice prolamin promoter. Similar strength and/or similar expression pattern may be analysed, for example, by coupling the promoters to a reporter gene and checking the function of the reporter gene in tissues of the plant. One well-known reporter gene is beta-glucuronidase and the colorimetric GUS stain used to visualize beta-glucuronidase activity in plant tissue. Examples of other endosperm-specific promoters which may also be used perform the methods of the invention are shown in Table 6 in the "Definitions" section herein.

Optionally, one or more terminator sequences may also be used in the construct introduced into a plant. The term "terminator" is as defined herein in the "Definitions" section.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

The genetic construct may optionally comprise a selectable marker gene as defined herein in the "Definitions" section.

The present invention also encompasses plants including plant parts obtainable by the methods according to the present invention having increased seed yield relative to suitable control plants and which have reduced or substantially eliminated expression of an endogenous CKI gene in plant endosperm tissue.

The invention also provides a method for the production of transgenic plants having increased seed yield relative to suitable control plants, which transgenic plants have reduced or substantially eliminated expression of an endogenous CKI gene in plant endosperm tissue.

More specifically, the present invention provides a method for the production of transgenic plants having increased seed yield which method comprises:
 (i) introducing and expressing in a plant, plant part or plant cell a gene construct comprising one or more control sequences capable of preferentially driving expression of a sense and/or antisense CKI nucleic acid sequence in plant endosperm tissue so as to silence an endogenous CKI gene in endosperm tissue of a plant; and
 (ii) cultivating the plant, plant part or plant cell under conditions promoting plant growth and development.

Preferably, the construct introduced into a plant is one comprising an inverted repeat (in part or complete) of a CKI gene or fragment thereof, preferably capable of forming a hairpin structure.

According to a preferred feature of the present invention, the construct is introduced into a plant by transformation.

The term "transformation" is as defined in the "Definitions" section herein.

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also extends to harvestable parts of a plant such as seeds and products derived, preferably directly derived, from a harvestable part of such a plant, such as dry pellets or powders, oil, fat and fatty acids, starch or proteins.

The present invention also encompasses use of CKI nucleic acids for the reduction or substantial elimination of endogenous CKI gene expression in plant endosperm tissue for increasing plant seed yield as defined hereinabove.

DESCRIPTION OF FIGURES

The present invention will now be described with reference to the following figures in which:

FIG. 1 gives an overview of the conserved motifs present in SEQ ID NO: 2. The leucine rich domain is underlined, the conserved motifs 1, 2 and 3 are indicated in bold and the sequence in italics represents the putative N-glycosylation site with the putative protein kinase C phosphorylation site.

FIG. 2 shows a multiple alignment of various SYR proteins. The asterisks indicate identical amino acid residues, the colons represent highly conserved substitutions and the dots represent less conserved substitutions. With the information from FIG. 1, the various domains and conserved motifs in SEQ ID NO: 2 can be easily identified in the other SYR proteins.

FIG. 5 details examples of sequences useful in performing the methods according to the present invention. SEQ ID NO:

1 and SEQ ID NO: 2 represent the nucleotide and protein sequence of SYR used in the examples. The start and stop codons in SEQ ID NO: 1 are given in bold. SEQ ID NO: 3 and SEQ ID NO: 4 are primer sequences used for isolating the SYR nucleic acid. SEQ ID NO: 5 is the sequence of the GOS2 promoter and SEQ ID NO: 33 of the PRO0170 promoter as used in the examples, SEQ ID NO: 6 to SEQ ID NO: 11 represent consensus sequences of conserved parts in the SYR proteins. SEQ ID NO: 12 to 25, 27 to 32 and 36 to 42 are nucleotide (full length or partial) and protein sequences of homologues of the SYR gene and protein as given in SEQ ID NO: 1 and SEQ ID NO: 2. SEQ ID NO: 26 represents the ARGOS protein sequence (GenBank accession AY305869).

FIG. 6 gives an overview of FG-GAP protein domains. The protein of SEQ ID NO: 46 comprises secretion signal (boxed N-terminal part), an FG-GAP domain starting at P73 and ending with L98, indicated in bold and underlined, and a transmembrane domain (bold and boxed). The conserved motif DXDXDGXX(D/E) (SEQ ID NO: 52) is boxed and underlined, wherein the motif DGXX(D/E) (SEQ ID NO: 51) is in italics. The conserved FDGYLYLID (SEQ ID NO: 294) domain is underlined.

FIG. 7 shows a multiple alignment of full length FG-GAP proteins (SEQ ID NO: 46, SEQ ID NO: 55, SEQ ID NO: 57 and SEQ ID NO: 59), the asterisks indicate identical amino acids, the colons indicate highly conserved substitutions and the dots indicate less conserved substitutions. The partial sequences listed in Table G of Example 12 may be useful in such a multiple alignment for the identification of additional motifs.

FIG. 8 shows a binary vector for transformation and expression in *Oryza sativa* of an *Arabidopsis thaliana* FG-GAP encoding nucleic acid under the control of a rice GOS2 promoter.

FIG. 9 details examples of sequences useful in performing the methods according to the present invention. SEQ ID NO: 45 and SEQ ID NO: 46 represent the nucleotide and protein sequence of FG-GAP used in the examples; the start and stop codons in SEQ ID NO: 45 are given in bold. SEQ ID NO: 47 and SEQ ID NO: 48 are primer sequences used for isolating the FG-GAP nucleic acid. SEQ ID NO: 49 is the sequence of the promoter-gene combination as used in the examples, SEQ ID NO: 50 to SEQ ID NO: 53 represent consensus sequences of conserved parts in the FG-GAP proteins. SEQ ID NO: 54 to 71 are nucleotide (full length or partial) and protein sequences of homologues of the FG-GAP gene and protein as given in SEQ ID NO: 45 and SEQ ID NO: 46. SEQ ID NO: 72 is the genomic sequence encoding a *Medicago sativa* FG-GAP protein which protein comprises the peptide sequences represented by SEQ ID NO: 72 to 76.

Figure 3:
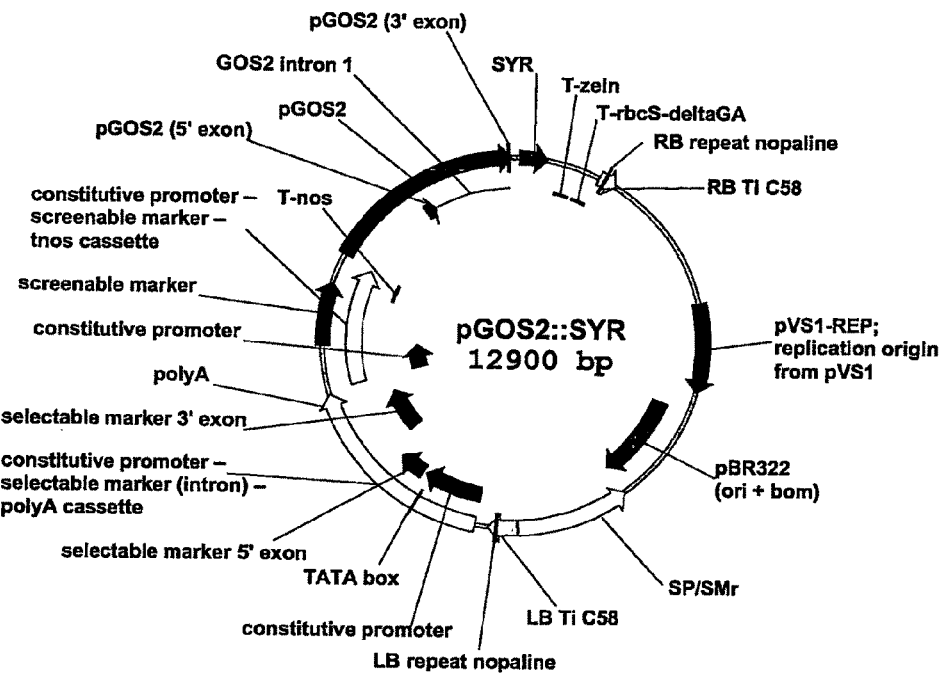
FIG. 3 shows binary vectors for transformation and expression in *Oryza sativa* of an *Oryza sativa* SYR nucleic acid. In pGOS2::SYR, the SYR coding sequence is under the control of a rice GOS2 promoter.
Figure 4:
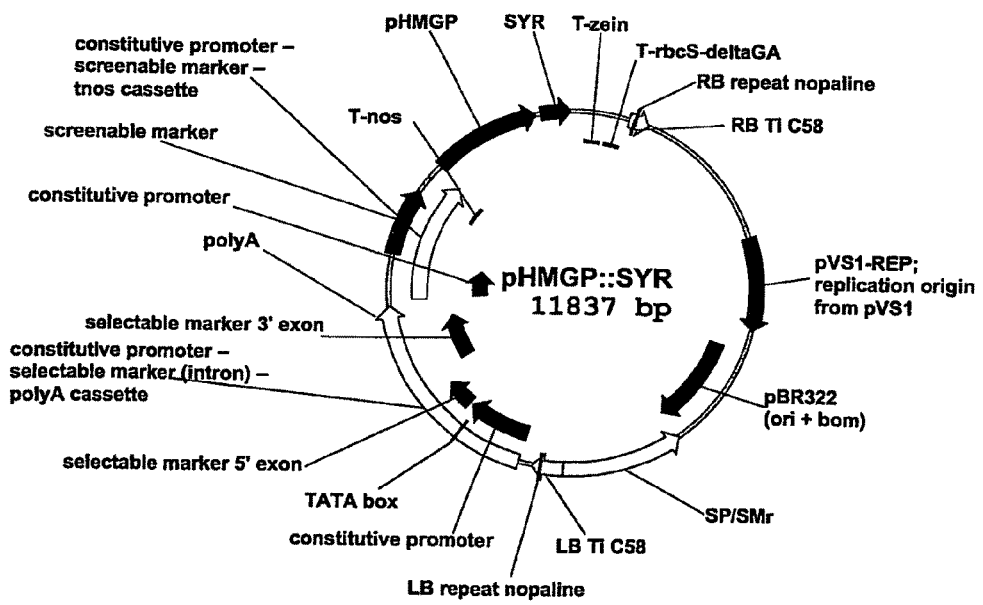
FIG. 4 shows binary vectors for transformation and expression in *Oryza sativa* of an *Oryza sativa* SYR nucleic acid. In pHMGP::SYR, the SYR coding sequence is under the control of a rice HMGP promoter (SEQ ID NO: 18 in WO 2004/070039, which SEQ ID NO: 18 of WO 2004/070039 is incorporated herein as if fully set forth).
Figure 10:
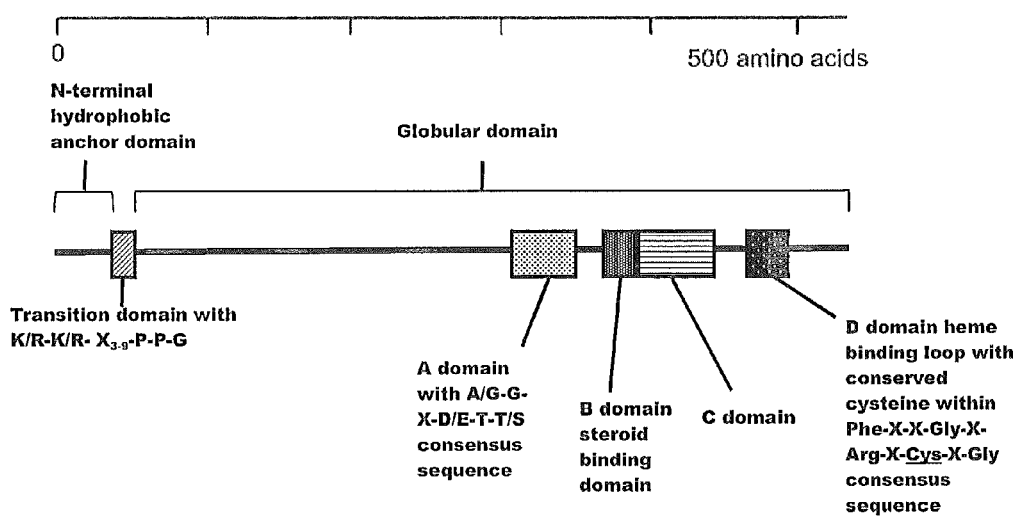

FIG. 10 shows the important features found in CYP90B polypeptides or homologues thereof: the N-terminal hydrophobic domain, the transition domain (with the K/R-K/R-X3-9-P-P-G (SEQ ID NO: 295) the A to D domains. Within the A domain the consensus sequence Ala/Gly-Gly-X-Asp/Glu-Thr-Thr/Ser (SEQ ID NO: 293) is identified. The consensus sequence Phe-Ala-Gly-His-Glu-Thr-Ser-Ser (SEQ ID NO: 290) of the CYP90B polypeptides comprises this consensus sequence Ala/Gly-Gly-X-Asp/Glu-Thr-Thr/Ser (SEQ ID NO: 293). Phe-X-X-Gly-X-Arg-X-Cys-X-Gly is SEQ ID NO: 292.

Figure 11:
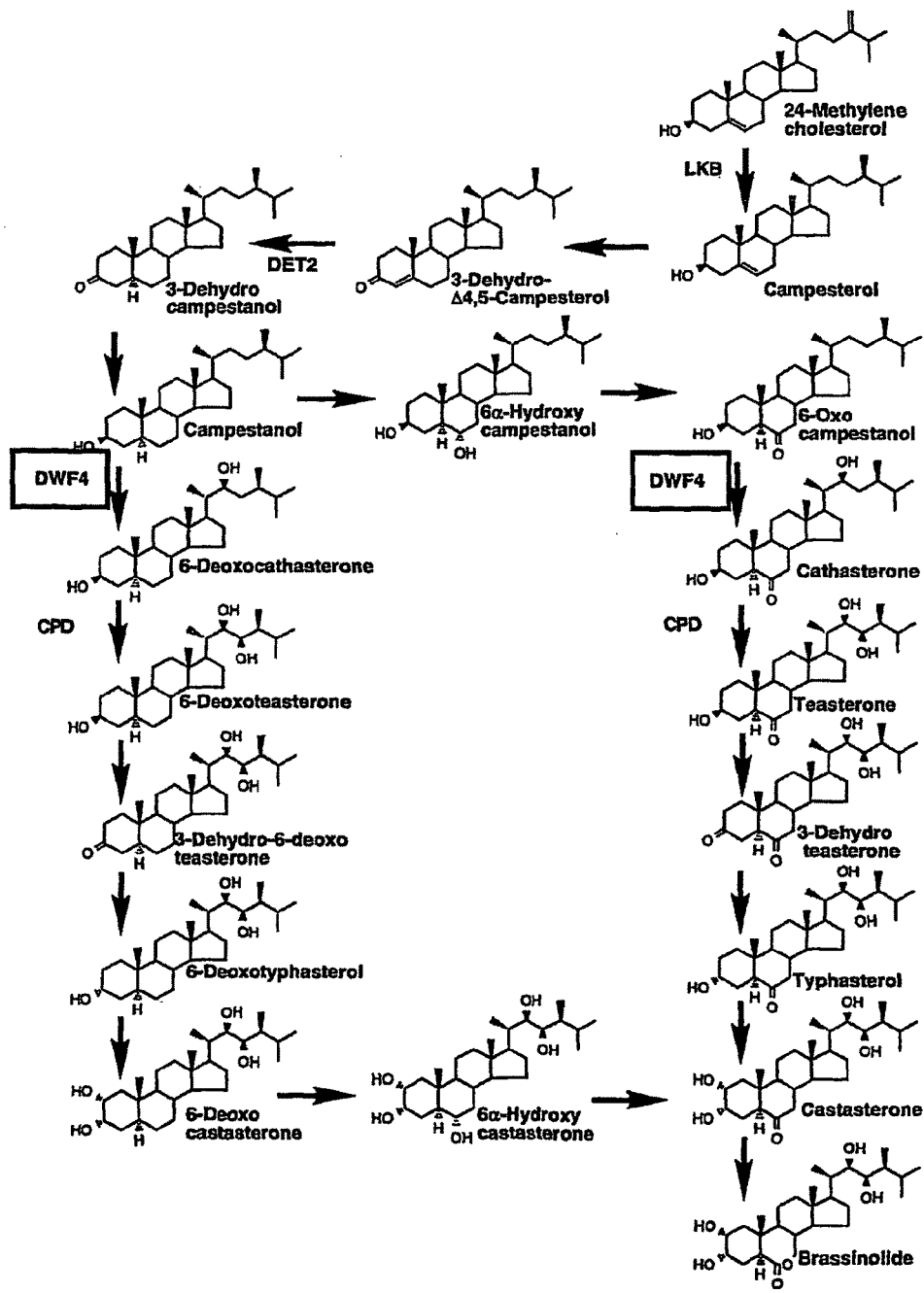

FIG. 11 shows the branched brassinosteroid biosynthetic pathway. In *Arabidopsis*, the CYP90B1/DWF4 polypeptide comprises the steroid 22-alpha hydroxylase enzymatic activity.

Figure 12:
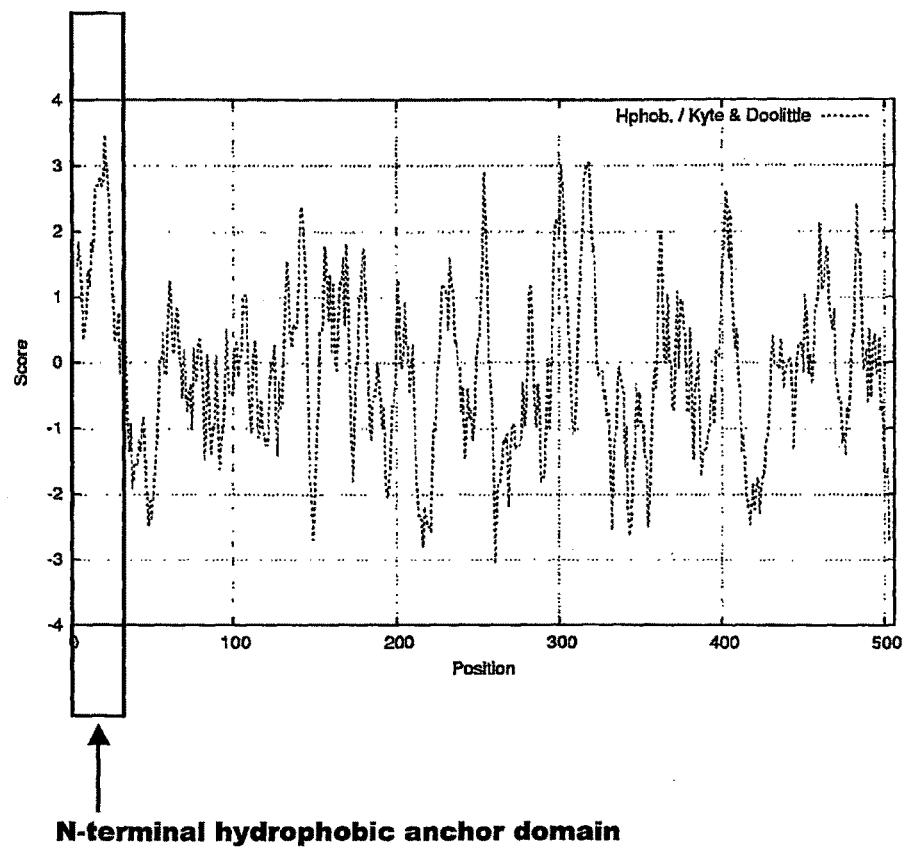

FIG. 12 shows the ProtScale output profile for hydrophobicity of the CYP90B polypeptide of the invention. The first N-terminal 34 amino acids (boxed) represent a hydrophobic domain, as these are located above the zero delimiting line. This region corresponds to the N-terminal anchor domain.

FIG. 13 shows a multiple alignment of several plant CYP90B polypeptides, using VNTI AlignX multiple alignment program, based on a modified ClustalW algorithm (InforMax, Bethesda, Md., informaxinc.com), with default settings for gap opening penalty of 10 and a gap extension of 0.05). The N-terminal hydrophobic domain, the transition domain (with the K/R-KJR-X3-9-P-P-G (SEQ ID NO: 295) and the A to D domains are indicated. The consensus sequence Phe-Ala-Gly-His-Glu-Thr-Ser-Ser (SEQ ID NO: 290) is boxed within the A domain. The accession numbers of the CYP90B polypeptides may be found in Table 9a and 9b. The *Arabidopsis* Arath_CYP90A1_CPD (At5g05690), Arath_CYP90C1_ROT3 (At4g36380) and Arath_CYP90D1 (At3g13730) are shown as non-CYP90B polypeptides. Sequences shown are: Orysa_CYP90B (SEQ ID NO: 78); Arath_CYP90B1_DWF4 (SEQ ID NO: 80); Sacof_CYP90B (SEQ ID NO: 82); Allce_CYP90B (SEQ ID NO: 84); Zinel_CYP90B (SEQ ID NO: 86); Medtr_CYP90B (SEQ ID NO: 88); Poptr_CYP90B (SEQ ID NO: 90); Aqufo_CYP90B partial (SEQ ID NO: 92); Triae_CYP90B partial (SEQ ID NO: 94); Eupes_CYP90B partial (SEQ ID NO: 98 Goshi_CYP90B partial (SEQ ID NO: 100); Lyces_CYP90B partial (SEQ ID NO: 102); Arath_CYP90A1 CPD (SEQ ID NO: 296); Arath_CYP90C1_ROT3 (SEQ ID NO: 297); Arath_CYP90D1 (SEQ ID NO: 298); and Consensus (SEQ ID NO: 314).

Figure 14:
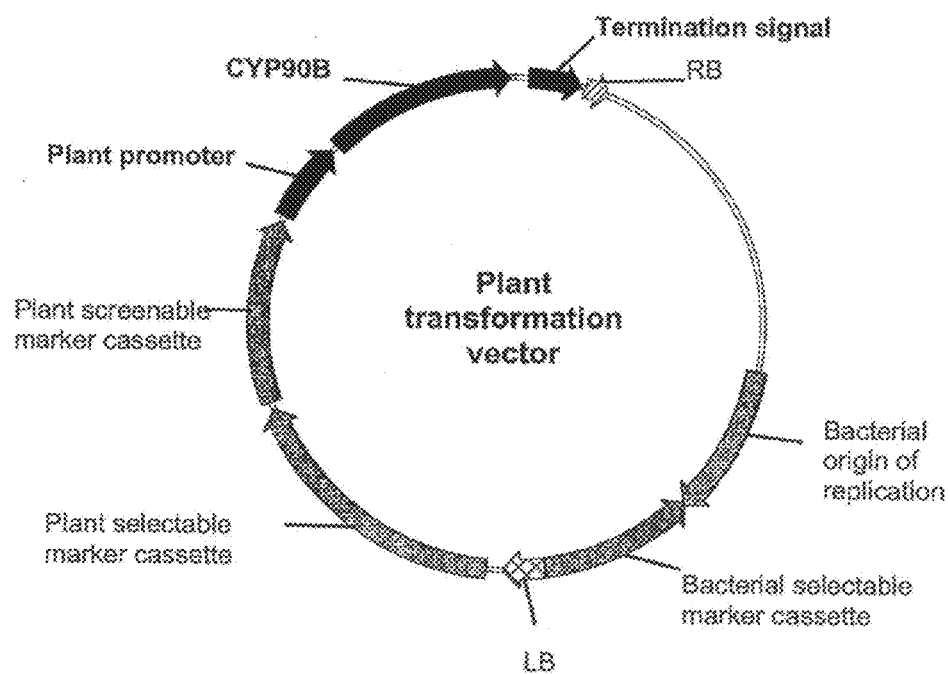

FIG. 14 shows a plant transformation vector for expression in *Oryza sativa* of an *Oryza sativa* CYP90B nucleic acid under the control of a plant promoter, which may be a non-constitutive promoter (such as endosperm or embryo/aleurone specific) or a constitutive promoter (such as GOS2 and HMGB1).

FIG. 15 details examples of sequences useful in performing the methods according to the present invention. Several sequences result from public EST assemblies (see Table 9a), with lesser quality sequencing. As a consequence, a few nucleic acid substitutions may be expected. The start (ATG) and stop codons delimit the nucleic acid sequences when these are full length.

Figure 16:
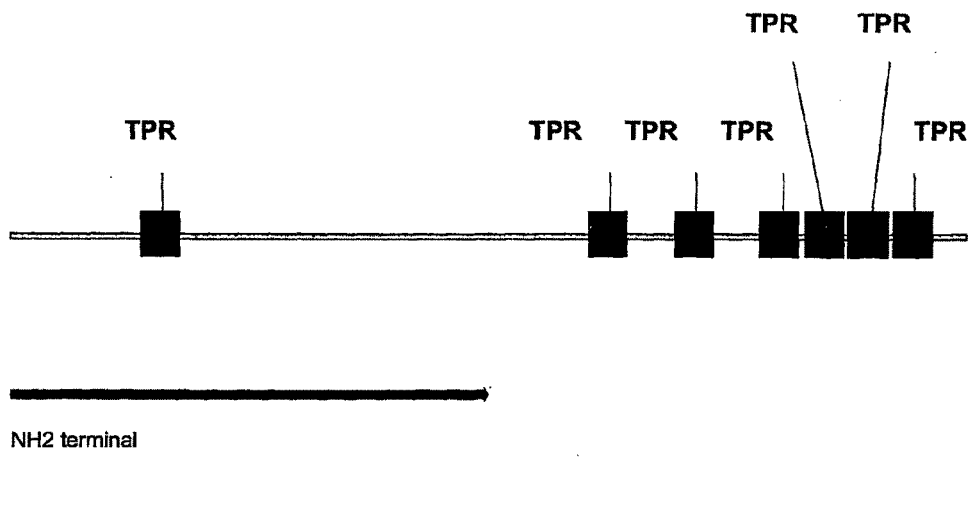

FIG. 16 represents a schematic figure of a full length CDC27 polypeptide (more specifically the *Arabidopsis thaliana* CDC27B hobbit polypeptide). The tetratrico peptide repeats (TPR) are represented as black boxes. The NH$_2$ terminal region of the polypeptide is represented as a black bar.

FIG. 17 shows the multiple alignment of CDC27 polypeptides from different sources, using VNTI AlignX multiple alignment program, based on a modified ClustalW algorithm (InforMax, Bethesda, Md., webpage at informaxinc.com), with default settings for gap opening penalty of 10 and a gap extension of 0.05). The tetratrico peptide repeats (TPR) are boxed across the alignment. The conserved NH$_2$ domain PD011373 (as defined in ProDom, ribosome.toulouse.inra.fr/prodom/current/cgi-bin/ProDomBlast3.p1) is double-underlined. Sequences shown are: Arath_CDC27A (SEQ ID NO: 134); Arath_CDC27B_Hobbit (SEQ ID NO: 132); Soltu_CDC27 (SEQ ID NO: 138); Orysa_CDC27 (SEQ ID NO: 136); Sacof_CDC27 partial (SEQ ID NO: 146); Aspni_BIMA (SEQ ID NO: 142); Schpo_nuc2+ (SEQ ID NO: 140); Homsa_CDC27 (SEQ ID NO: 144); and Consensus (SEQ ID NO: 315).

Figure 18:
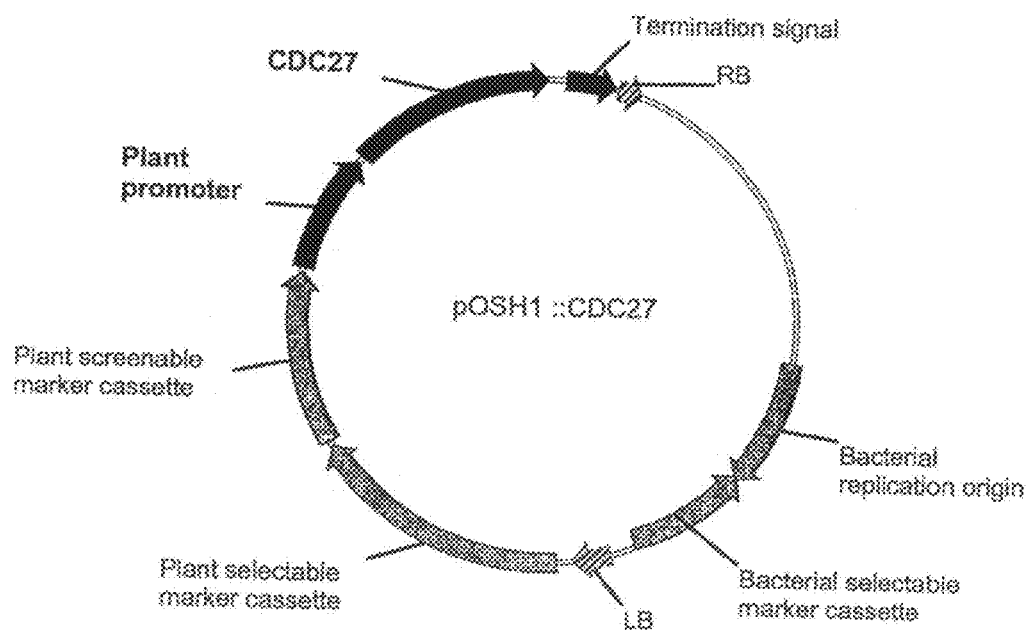

FIG. 18 shows a binary vector pOSH1::CDC27 for expression in *Orysa sativa* of a modified *Arabidopsis thaliana* CDC27 nucleic acid under the control of a plant promoter which is a shoot apical meristem promoter.

FIG. 19 shows a table listing partial and full length CDC27 orthologs and paralogs from different sources, produced by TIGR (Institute for Genomic Research at webpage tigr.org). TC895803 may be found webpage tigr.org/tigr-scripts/tgi/ego/ego_report.pl?ego=895803.

FIG. 20 details examples of sequences useful in performing the methods according to the present invention, or useful in isolating such sequences. Several sequences result from public EST assemblies (see Table 10), with lesser quality sequencing. As a consequence, a few nucleic acid substitutions may be expected. The start (ATG) and stop codons delimit the nucleic acid sequences when these encode full length CDC27 polypeptides.

Figure 21:
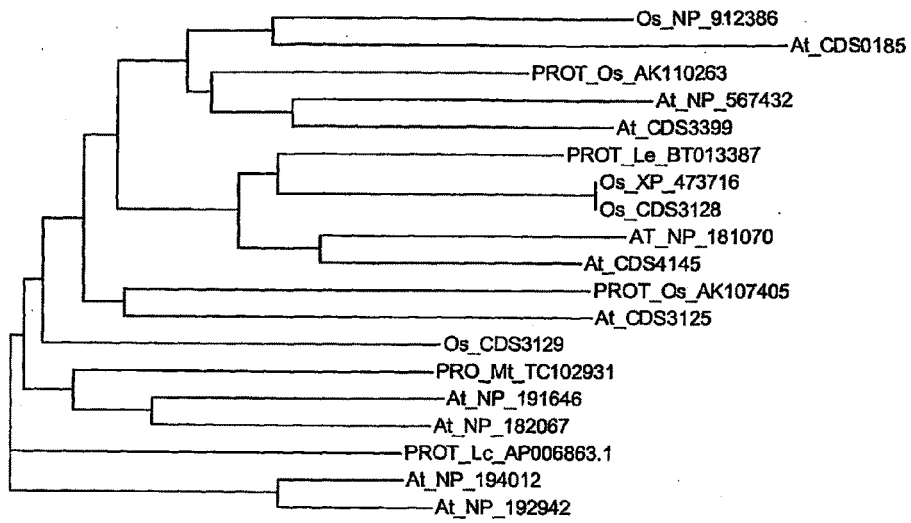

FIG. 21 shows a phylogenetic tree of various polypeptide sequences comprising an AT-hook domain and a DUF296 domain. The phylogenetic tree was made using VNTI AlignX multiple alignment program, based on a modified ClustalW algorithm (InforMax, Bethesda, Md., webpage at informaxinc.com), with default settings for gap opening penalty of 10 and a gap extension of 0.05).

Figure 22:
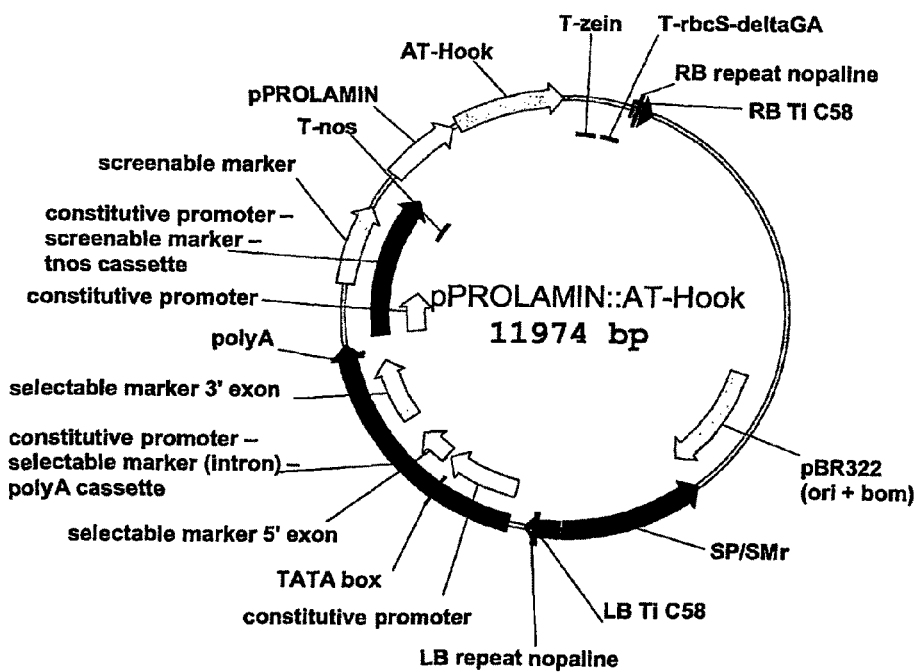

FIG. 22 shows a binary vector pPROLAMIN::AT-hook, for expression in Oryza sativa of an Oryza sativa nucleic acid encoding a polypeptide comprising an AT-hook domain and a DUF296 domain and Motif 2 under the control of a prolamin promoter.

Figure 23:
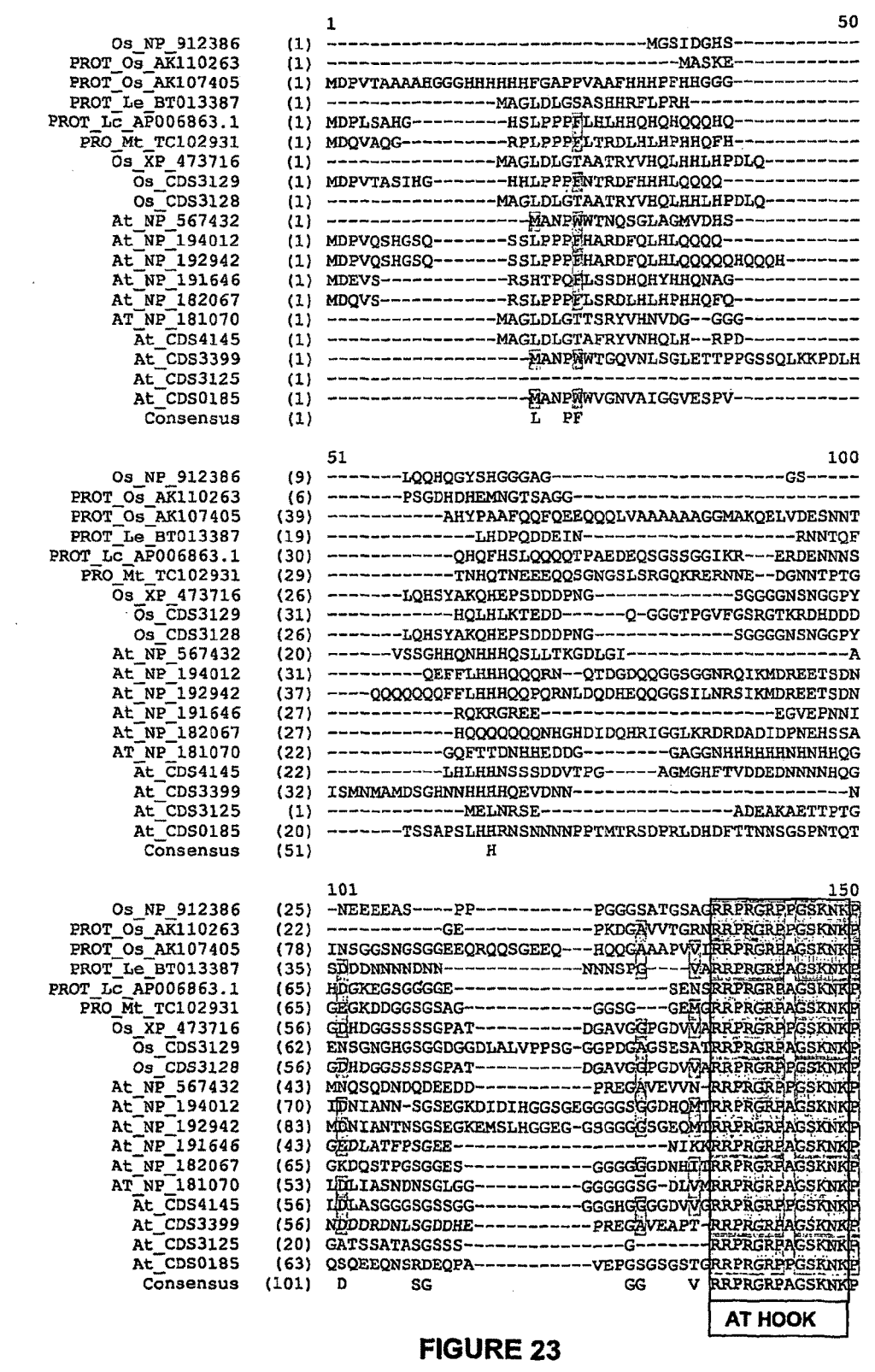

FIG. 23 shows a multiple alignment of a polypeptide comprising an AT-hook domain and a DUF296 domain, prepared using VNTI AlignX multiple alignment program, based on a modified ClustalW algorithm (InforMax, Bethesda, Md., webpage at informaxinc.com), with default settings for gap opening penalty of 10 and a gap extension of 0.05. Shown in the alignment is the AT-hook domain and the DUF296 domain and Motif 2 in bold, italics and underlined. Sequences shown are: Os_NP_912386 (SEQ ID NO: 171); PROT_Os_AK110263 (SEQ ID NO: 179); PROT_Os_AK107405 (SEQ ID NO: 169); PROT_Le_BT013387 (SEQ ID NO: 173); PROT_Lc_AP006863.1 (SEQ ID NO: 157); PRO_Mt_TC102931 (SEQ ID NO: 189); Os_XP_473716 (SEQ ID NO: 155); Os_CDS3129 (SEQ ID NO: 153); Os_CDS3128 (SEQ ID NO: 185); At_NP_567432 (SEQ ID NO: 181); At_NP_194012 (SEQ ID NO: 161); At_NP_192942 (SEQ ID NO: 159); At_NP_191646 (SEQ ID NO: 165); At_NP_182067 (SEQ ID NO: 163); AT_NP_181070 (SEQ ID NO: 187); At_CDS4145 (SEQ ID NO: 183); At_CDS3399 (SEQ ID NO: 177); At_CDS3125 (SEQ ID NO: 175); At_CDS0185 (SEQ ID NO: 167); and Consensus (SEQ ID NO: 316).

FIG. 24 details examples of sequences useful in performing the methods according to the present invention.

Figure 25:
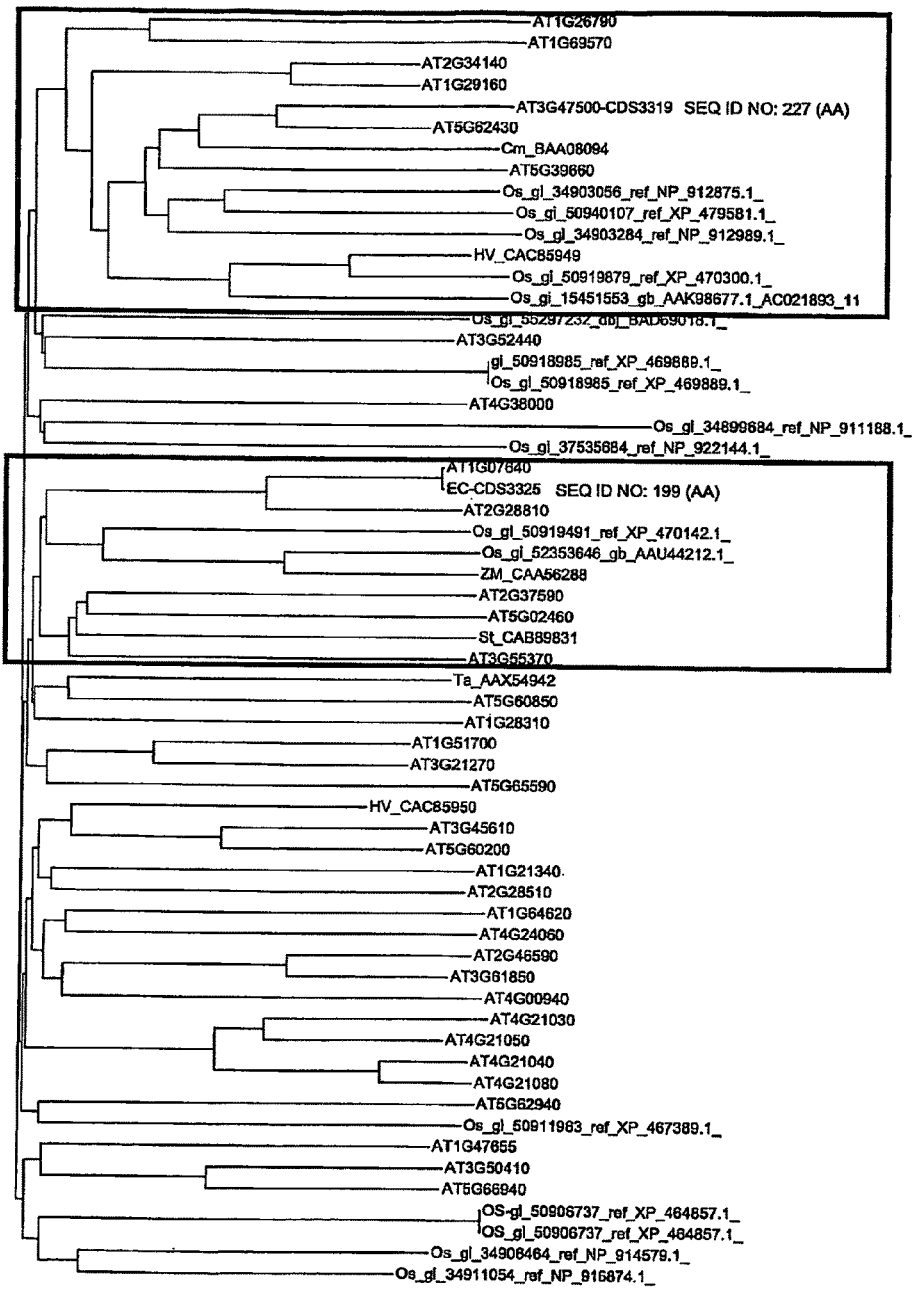

FIG. 25 shows a phylogenetic tree of DOF transcription factors. The box nearest the top shows the major clustering of sequences sharing homology to SEQ ID NO: 227 (and comprising features (i) and (iii) as defined hereinabove, i.e. at least 60% sequence identity to either the DOF domain represented by SEQ ID NO: 200 or SEQ ID NO: 228; and Motif I and/or Motif II as defined hereinabove). The box nearest the bottom shows the major clustering of sequences sharing homology to SEQ ID NO: 199 (and comprising features (i) and (ii) as defined hereinabove, i.e. at least 60% sequence identity to either the DOF domain represented by SEQ ID NO: 200 or SEQ ID NO: 228; and at least 70% sequence identity to the DOF domain represented by SEQ ID NO: 200).

Figure 26:
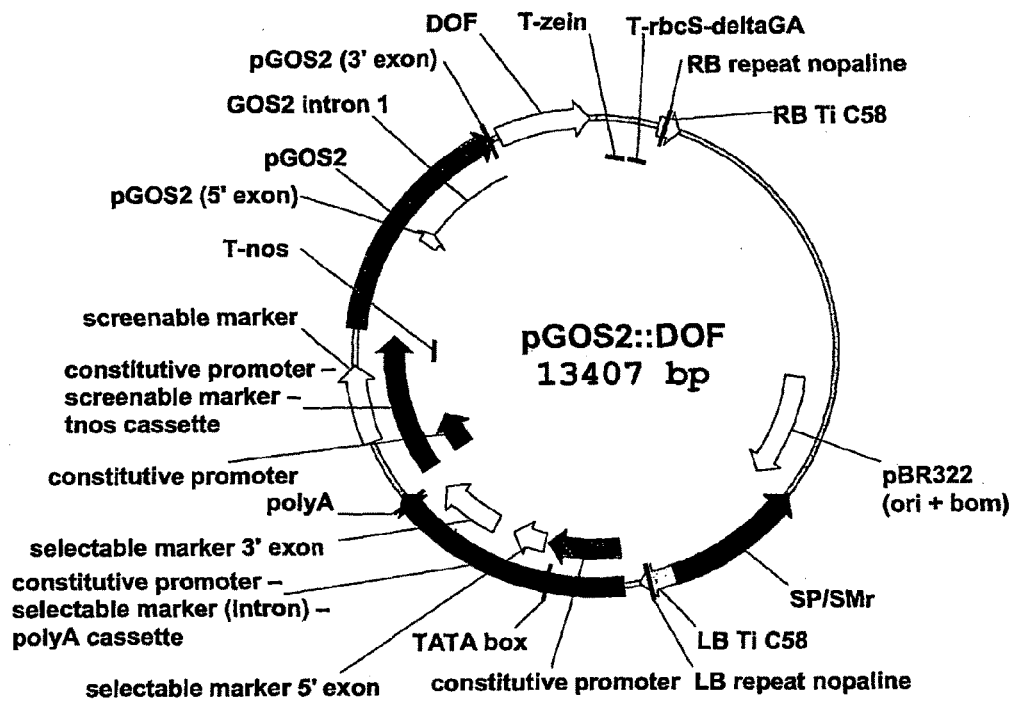

FIG. 26 shows a binary vector pGOS2::DOF, for expression in Oryza sativa of an Arabidopsis thaliana DOF transcription factor under the control of a GOS2 promoter.

Figure 27:
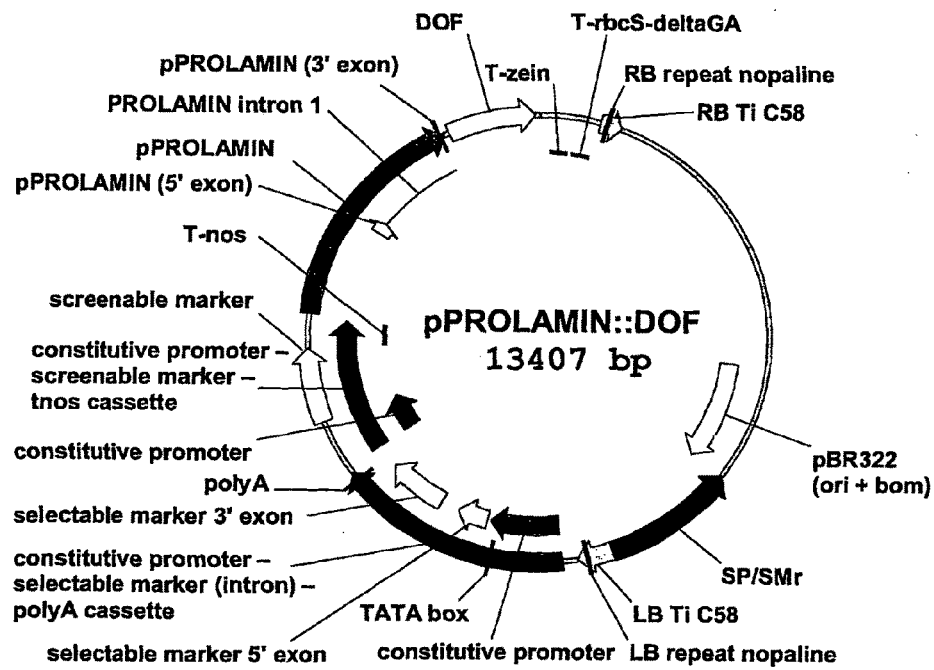

FIG. 27 shows a binary vector pPROLAMIN:DOF, for expression in Oryza sativa of an Arabidopsis thaliana DOF transcription factor under the control of a prolamin promoter.

FIG. 28 details examples of sequences useful in performing the methods according to the present invention.

Figure 29:
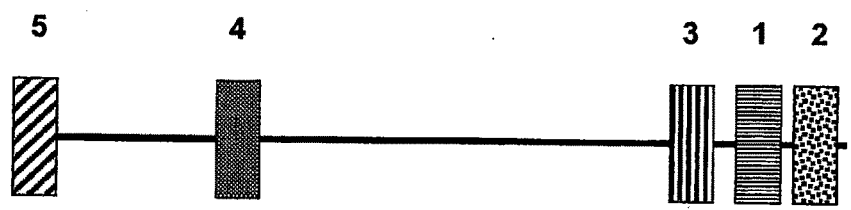

FIG. 29 is a schematic representation of a full-length plant CKI polypeptide. The typical motifs 1 to 5 (SEQ ID NO: 261 to SEQ ID NO: 265) useful in identifying CKIs are boxed and numbered accordingly (motif 6 not shown).

Figure 30:
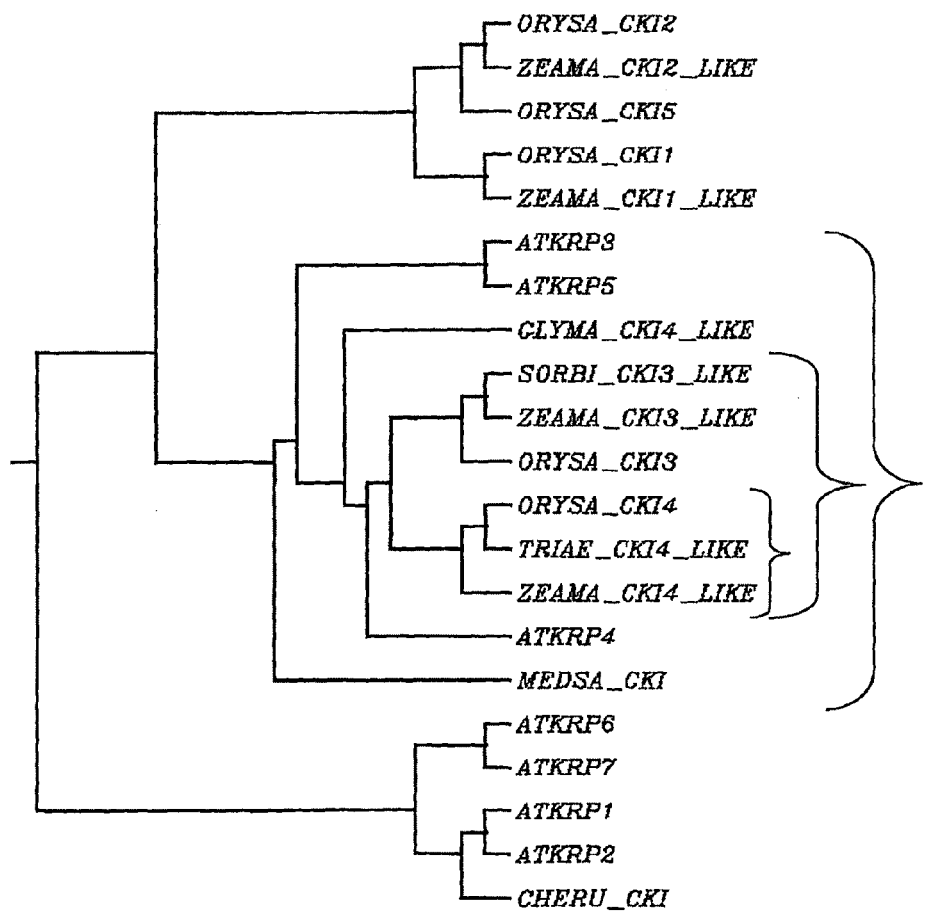

FIG. 30 shows a neighbour-joining tree from a multiple alignment of CKI polypeptides from different sources, and made using the ClustalW public software available at clustalw.genome.jp, with the default settings. A subgroup of monocot and dicot CKI4s is indicated by the large bracket. Within this subgroup, monocot CKIs cluster together, as indicated by the medium bracket. The monocot CKI4 branch is indicated by the small bracket.

Figure 31:
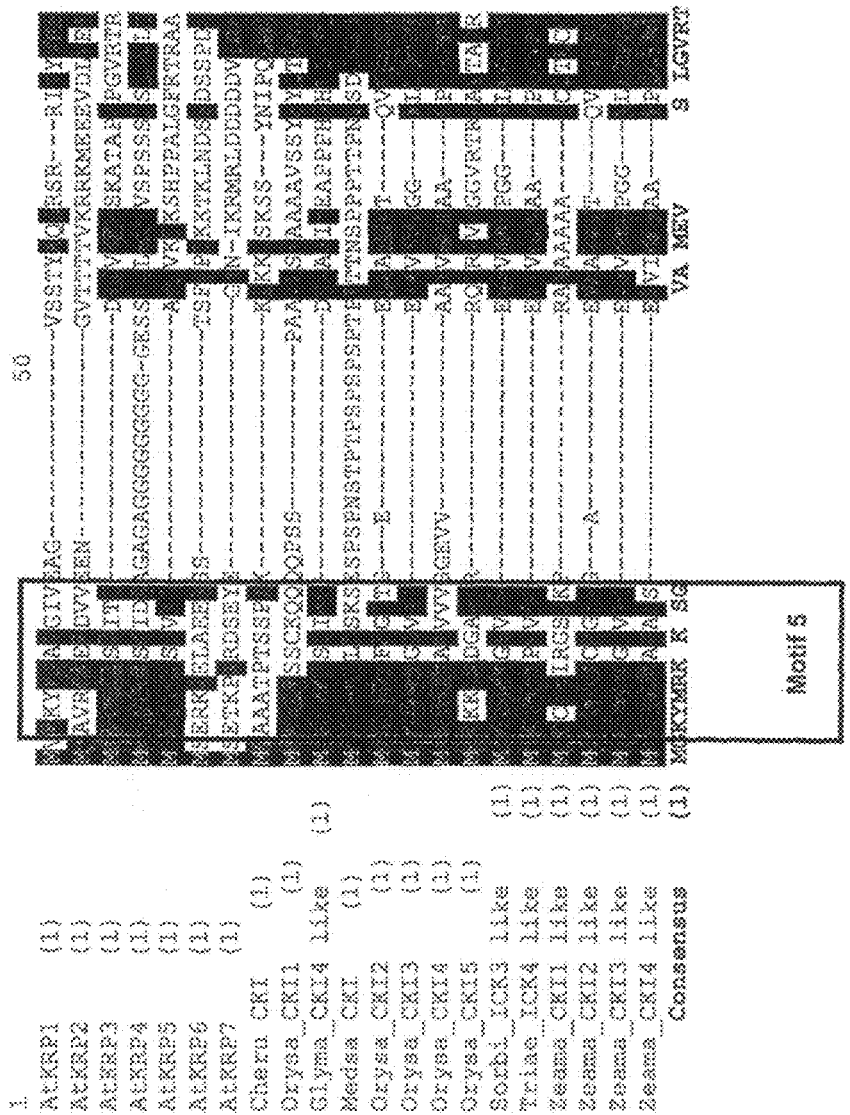
Figure 31:
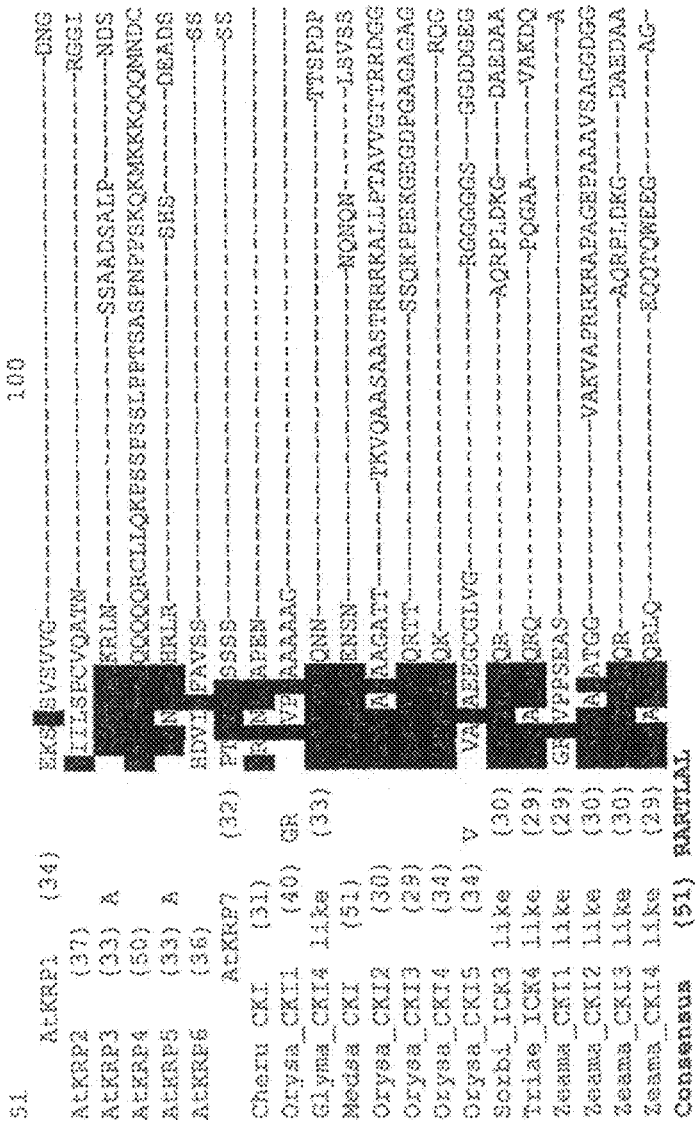
Figure 31:
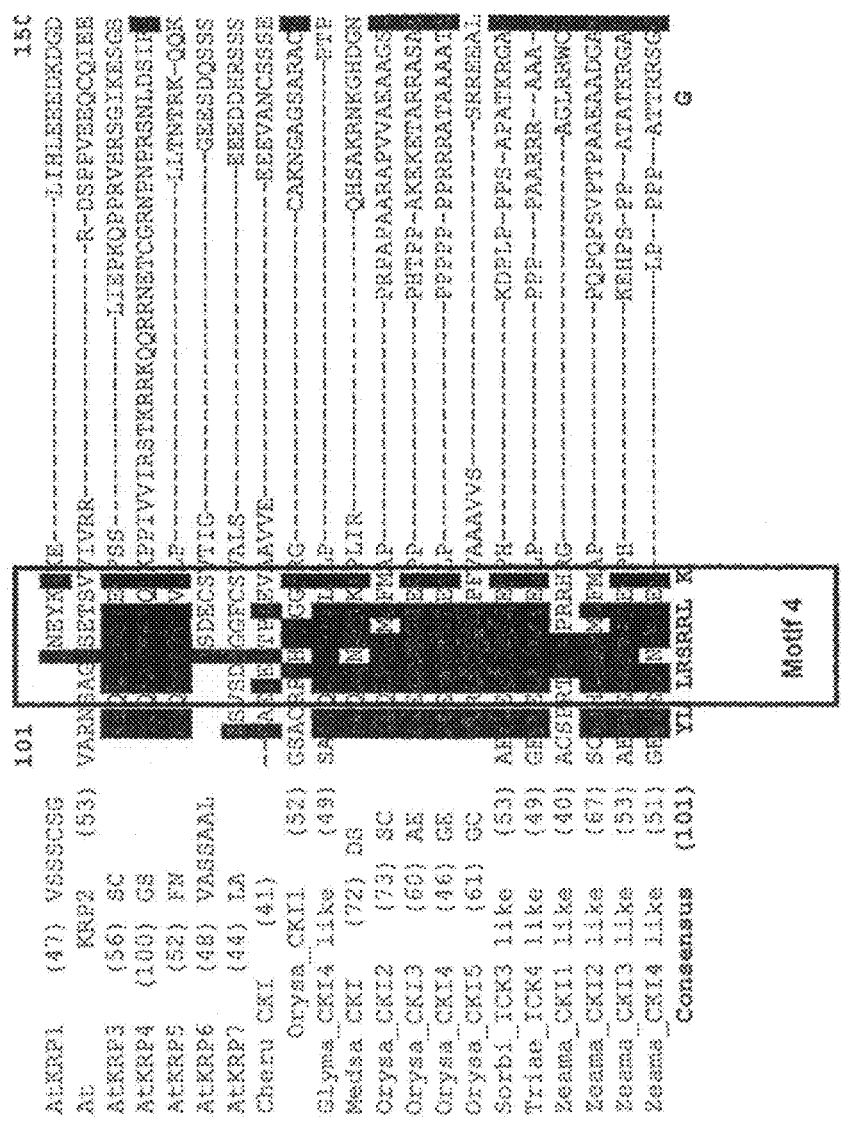
Figure 31:
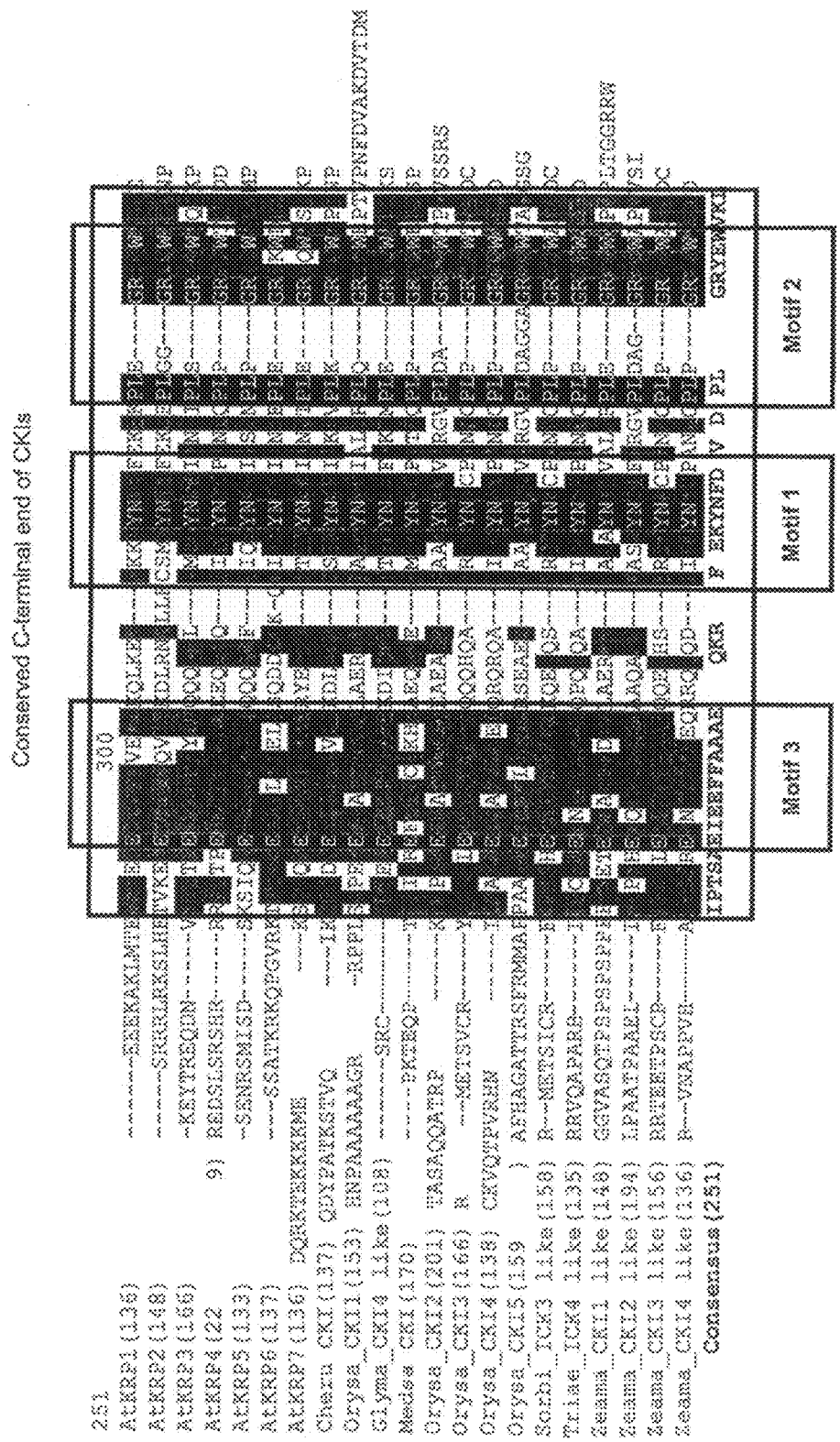

FIG. 31 is a multiple alignment of CKI polypeptides from different plant sources, made using VNTI AlignX multiple alignment program, based on a modified ClustalW algorithm (InforMax, Bethesda, Md., webpage at informaxinc.com), with default settings for gap opening penalty of 10 and a gap extension of 0.05). The conserved C-terminal end of CKIs is boxed, as well as motifs 1 to 5 (SEQ ID NO: 261 to SEQ ID NO: 265) useful in identifying plant CKIs (motif 6 not shown). Sequences shown are: AtKRP1 (SEQ ID NO: 299); AtKRP2 (SEQ ID NO: 300); AtKRP3 (SEQ ID NO: 301); AtKRP4 (SEQ ID NO: 302); AtKRP5 (SEQ ID NO: 303); AtKRP6 (SEQ ID NO: 304); AtKRP7 (SEQ ID NO: 305); Cheru CKI (SEQ ID NO: 306); Orysa_CKI1 (SEQ ID NO: 307); Glyma_CKI4 like (SEQ ID NO: 308); Medsa CKI (SEQ ID NO: 309); Orysa_CKI2 (SEQ ID NO: 310); Orysa_CKI3 (SEQ ID NO: 274); Orysa_CKI4 (SEQ ID NO: 268); Orysa_CKI5 (SEQ ID NO: 311); Sorbi_ICK3 like (SEQ ID NO: 278); Triae_ICK4 like (SEQ ID NO: 272); Zeama_CKI1 like (SEQ ID NO: 312); Zeama_CKI2 like (SEQ ID NO: 313); Zeama_CKI3 like (SEQ ID NO: 276); Zeama_CKI4 like (SEQ ID NO: 270); and Consensus (SEQ ID NO: 317).

Figure 32:
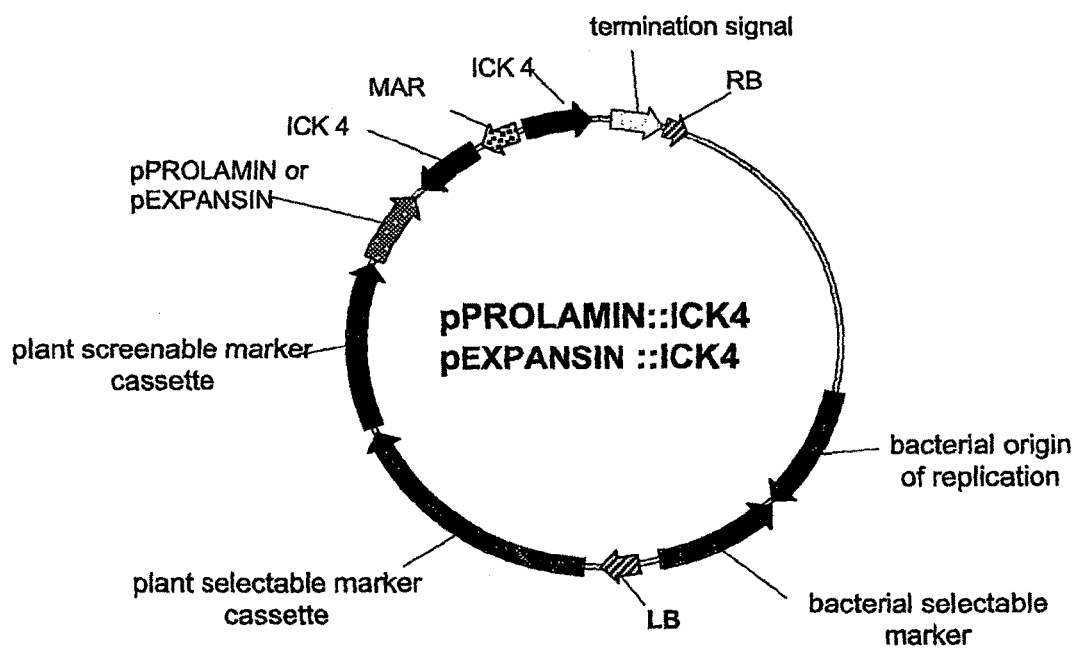

FIG. 32 shows a binary vector for CKI RNA silencing in Oryza sativa, using a hairpin construct, under the control of an endosperm-specific promoter and under the control of a shoot-specific promoter.

FIG. 33 details examples of sequences useful in performing the methods according to the present invention, or useful in isolating such sequences. Several sequences result from public EST assemblies, with lesser quality sequencing. As a consequence, a few nucleic acid substitutions may be expected. The start (ATG) and stop codons delimit the nucleic acid sequences when these encode full-length CKI polypeptides. However both 5' and 3' UTR may also be used for the performing the methods of the invention.

EXAMPLES

The present invention will now be described with reference to the following examples, which are by way of illustration alone. The following examples are not intended to completely define or to otherwise limit the scope of the invention.

DNA Manipulation

Unless otherwise stated, recombinant DNA techniques are performed according to standard protocols described in (Sambrook (2001) Molecular Cloning: a laboratory manual, 3rd Edition, Cold Spring Harbor Laboratory Press, CSH, New York) or in Volumes 1 and 2 of Ausubel et al. (1994), Current Protocols in Molecular Biology, Current Protocols (http://www.4ulr.com/products/currentprotocols/index.

html). Standard materials and methods for plant molecular work are described in Plant Molecular Biology Labfax (1993) by R.D.D. Croy, published by BIOS Scientific Publications Ltd (UK) and Blackwell Scientific Publications (UK).

Statistical Analysis

A two factor ANOVA (analyses of variance) corrected for the unbalanced design was used as statistical model for the overall evaluation of plant phenotypic characteristics. An F-test was carried out on all the parameters measured of all the plants of all the events transformed with that gene. The F-test was carried out to check for an effect of the gene over all the transformation events and to verify for an overall effect of the gene, also named herein "global gene effect". If the value of the F test shows that the data are significant, than it is concluded that there is a "gene" effect, meaning that not only presence or the position of the gene is causing the effect. The threshold for significance for a true global gene effect is set at 5% probability level for the F test.

To check for an effect of the genes within an event, i.e., for a line-specific effect, a t-test was performed within each event using data sets from the transgenic plants and the corresponding null plants. "Null plants" or "null segregants" or "nullizygotes" are the plants treated in the same way as the transgenic plant, but from which the transgene has segregated. Null plants can also be described as the homozygous negative transformed plants. The threshold for significance for the t-test is set at 10% probability level. The results for some events can be above or below this threshold. This is based on the hypothesis that a gene might only have an effect in certain positions in the genome, and that the occurrence of this position-dependent effect is not uncommon. This kind of gene effect is also named herein a "line effect of the gene". The p-value Is obtained by comparing the t-value to the t-distribution or alternatively, by comparing the F-value to the F-distribution. The p-value then gives the probability that the null hypothesis (i.e., that there is no effect of the transgene) is correct.

Example A

SYR

Example 1

Identification of Sequences Related to SEQ ID NO: 1 and SEQ ID NO: 2

Sequences (full length cDNA, ESTs or genomic) related to SEQ ID NO: 1 and/or protein sequences related to SEQ ID NO: 2 were identified amongst those maintained in the Entrez Nucleotides database at the National Center for Biotechnology Information (NCBI) using database sequence search tools, such as the Basic Local Alignment Tool (BLAST) (Altschul et al., (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 1 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters were adjusted to modify the stringency of the search.

In addition to the publicly available nucleic acid sequences available at NCBI, other sequence databases may also searched following the same procedure as described above.

Table A provides a list of nucleic acid and protein sequences related to the nucleic acid sequence as represented by SEQ ID NO: 1 and the protein sequence represented by SEQ ID NO: 2.

TABLE A

Nucleic acid sequences related to the nucleic acid sequence (SEQ ID NO: 1) useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| OsSYR | Oryza sativa | 1 | 2 | / | Full length or partial |
| rice SYR homologue 1 | Oryza sativa | 12 | 27 | XP_472637 | Full length |
| rice SYR homologue 2 | Oryza sativa | 13 | | AP008218 | Full length |
| corn SYR homologue | Zea mays | 14 | 28 | AY110705 | partial |
| wheat SYR homologue | Triticum aestivum | 15 | | / | Full length |
| barley SYR homologue | Hordeum vulgare | 16 | 36 | CB871444 | Full length |
| sugar cane SYR homologue 1 | Saccharum officinarum | 17 | 37 | CA165713 | partial |
| sugar cane SYR homologue 2 | Saccharum officinarum | 18 | 38 | CA242805 | Full length |
| sorghum SYR homologue | Sorghum bicolor | 19 | 39 | CX611532 | Full length |
| AtSYR homologue 1 | Arabidopsis thaliana | 20 | 40 | NM_115853 | Full length |
| AtSYR homologue 2 | Arabidopsis thaliana | 21 | 41 | NM_180078 | Full length |

TABLE A-continued

Nucleic acid sequences related to the nucleic acid sequence (SEQ ID NO: 1) useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| grape SYR homologue | Vitis vinifera | 22 | 29 | CF404276 | Full length |
| Citrus SYR homologue | Citrus reticulata | 23 | 30 | CF830612 | partial |
| tomato SYR homologue 1 | Lycopersicon esculentum | 24 | 32 | AI774560 | Full length |
| tomato SYR homologue 2 | Lycopersicon esculentum | 25 | 31 | BG125370 | Full length |

Example 2

Alignment of Relevant Polypeptide Sequences

AlignX from the Vector NTI (Invitrogen) is based on the popular Clustal algorithm of progressive alignment (Thompson et al (1997) Nucleic Acids Res 25:4876-4882; Chema et al. (2003). Nucleic Acids Res 31:3497-3500). A phylogenetic tree can be constructed using a neighbour joining clustering algorithm. Default values are for the gap open penalty of 10, for the gap extension penalty of 0.1 and the selected weight matrix is Blosum 62 (if polypeptides are aligned).

The result of the multiple sequence alignment using polypeptides relevant in identifying the ones useful in performing the methods of the invention is shown in FIG. 2. The leucine rich repeat and the conserved motifs can be easily discriminated in the various sequences.

Example 3

Calculation of Global Percentage Identity between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
  Scoring matrix: Blosum62
  First Gap: 12
  Extending gap: 2

Results of the software analysis are shown in Table B for the global similarity and identity over the full length of the polypeptide sequences (excluding the partial polypeptide sequences). Percentage identity is given above the diagonal and percentage similarity is given below the diagonal.

The percentage identity between the polypeptide sequences useful in performing the methods of the invention can be as low as 27% amino acid identity compared to SEQ ID NO: 2.

TABLE B

MatGAT results for global similarity and identity over the full length of the polypeptide sequences.

| | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| 1. SEQID2 | | 29.8 | 46.8 | 55.2 | 67.0 | 66.1 | 66.7 | 71.4 | 63.6 | 36.8 | 34.6 | 35.5 | 39.7 | 39.0 | 41.0 | 27.6 | 32.1 |
| 2. SEQID12 | 40.4 | | 29.8 | 23.0 | 26.8 | 28.1 | 23.6 | 25.3 | 28.7 | 30.3 | 28.1 | 30.9 | 32.0 | 28.1 | 24.7 | 16.3 | 17.4 |
| 3. SEQID13 | 57.9 | 39.3 | | 42.9 | 46.0 | 47.6 | 44.4 | 47.6 | 45.2 | 31.9 | 33.3 | 33.1 | 34.1 | 37.3 | 34.1 | 24.8 | 28.3 |
| 4. SEQID14 | 59.0 | 32.0 | 50.8 | | 57.1 | 55.4 | 77.4 | 77.4 | 83.2 | 25.4 | 26.7 | 26.6 | 30.2 | 32.2 | 33.3 | 21.6 | 23.9 |
| 5. SEQID15 | 80.9 | 41.0 | 57.9 | 69.1 | | 89.1 | 63.4 | 67.9 | 66.1 | 36.9 | 31.9 | 33.1 | 40.5 | 37.3 | 40.9 | 24.8 | 27.9 |
| 6. SEQID16 | 79.1 | 38.2 | 59.5 | 65.5 | 95.5 | | 61.6 | 66.1 | 62.5 | 36.4 | 32.6 | 36.0 | 40.5 | 38.8 | 38.2 | 24.0 | 28.8 |
| 7. SEQID17 | 69.5 | 34.8 | 57.1 | 78.1 | 72.7 | 69.1 | | 94.9 | 81.3 | 30.8 | 29.6 | 31.7 | 34.1 | 34.7 | 39.4 | 25.5 | 29.0 |
| 8. SEQID18 | 74.3 | 37.1 | 60.3 | 80.0 | 77.3 | 73.6 | 94.9 | | 85.0 | 33.1 | 31.9 | 33.8 | 36.5 | 37.3 | 42.4 | 28.2 | 32.0 |
| 9. SEQID19 | 69.2 | 39.3 | 56.3 | 86.0 | 78.2 | 74.5 | 84.1 | 88.8 | | 36.9 | 32.6 | 36.7 | 38.1 | 39.8 | 40.2 | 28.8 | 29.6 |
| 10. SEQID20 | 54.6 | 41.6 | 56.9 | 46.2 | 57.7 | 60.8 | 50.0 | 53.1 | 54.6 | | 66.2 | 46.9 | 51.9 | 44.3 | 42.7 | 26.3 | 26.9 |
| 11. SEQID21 | 51.9 | 44.4 | 56.3 | 47.4 | 54.8 | 54.8 | 50.4 | 53.3 | 52.6 | 77.8 | | 49.0 | 46.8 | 41.1 | 39.3 | 28.7 | 27.2 |
| 12. SEQID22 | 54.0 | 43.8 | 54.7 | 45.3 | 53.2 | 54.0 | 49.6 | 51.8 | 54.7 | 65.5 | 65.5 | | 61.9 | 45.1 | 40.3 | 24.0 | 22.9 |
| 13. SEQID23 | 58.7 | 45.5 | 55.6 | 50.0 | 60.3 | 59.5 | 54.8 | 57.1 | 63.5 | 66.9 | 66.7 | 77.7 | | 53.8 | 44.4 | 27.0 | 27.6 |
| 14. SEQID24 | 61.9 | 42.7 | 57.9 | 55.1 | 58.5 | 63.6 | 61.0 | 63.6 | 62.7 | 66.9 | 64.4 | 68.3 | 77.0 | | 73.7 | 27.9 | 29.4 |
| 15. SEQID25 | 62.9 | 35.4 | 50.0 | 53.3 | 60.0 | 58.2 | 66.7 | 69.7 | 61.7 | 56.2 | 54.8 | 54.7 | 60.3 | 73.7 | | 36.7 | 38.6 |
| 16. SEQID34 | 45.7 | 25.3 | 38.1 | 38.1 | 39.1 | 40.0 | 45.5 | 48.5 | 44.9 | 40.0 | 40.7 | 36.0 | 41.3 | 41.5 | 56.3 | | 42.0 |
| 17. SEQID35 | 50.5 | 30.3 | 45.2 | 40.0 | 46.4 | 44.5 | 47.5 | 50.5 | 45.8 | 34.6 | 42.2 | 36.7 | 40.5 | 42.4 | 55.2 | 57.7 | |

Example 4

Topology Prediction of the Polypeptide Sequences Useful in Performing the Methods of the Invention TargetP 1.1 was used to predict the subcellular location of eukaryotic proteins. According to the program, the location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site may also be present.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 2 are presented Table C below. The "plant" organism group was been selected, no cutoffs defined, and the predicted length of the transit peptide requested. According to the results, the subcellular localization of the polypeptide sequence as represented by SEQ ID NO: 2 may be the mitochondrion; however the reliability class of 5 (i.e. the lowest reliability class) should be considered.

TABLE C

TargetP 1.1 analysis of the polypeptide sequence as represented by SEQ ID NO: 2

| | |
|---|---|
| Length (AA) | 105 |
| Chloroplastic transit peptide | 0.025 |
| Mitochondrial transit peptide | 0.552 |
| Secretory pathway signal peptide | 0.009 |
| Other subcellular targeting | 0.416 |
| Predicted Location | mitochondrion |
| Reliability class | 5 |

Two transmembrane domains were identified by the TMHMM program, hosted on the server of the Center for Biological Sequence Analysis, Technical University of Denmark. The results below show that the probability that the N-terminus is located inside is 0.997. Further details on the orientation are given in Table D below.

TABLE D results of TMHMM 2.0

| Orientation | begin-end residue | |
|---|---|---|
| inside | 1 | 42 |
| TMhelix | 43 | 65 |
| outside | 66 | 74 |
| TMhelix | 75 | 92 |
| inside | 93 | 105 |

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

Example 5

Gene Cloning

The *Oryza sativa* SYR gene was amplified by PCR using as template an *Oryza sativa* seedling cDNA library (Invitrogen, Paisley, UK). After reverse transcription of RNA extracted from seedlings, the cDNAs were cloned into pCMV Sport 6.0. Average insert size of the bank was 1.5 kb and the original number of clones was of the order of $1.59 \times 10^7$ cfu. Original titer was determined to be $9.6 \times 10^5$ cfu/ml after first amplification of $6 \times 10^{11}$ cfu/ml. After plasmid extraction, 200 ng of template was used in a 50 µl PCR mix. Primers prm08170 (SEQ ID NO: 3; sense, start codon in bold, AftB1 site in italic: 5'-ggggacaagtttgtacaaaaaagcag gcttaaacaatggaaggtgtaggt-gctagg-3') and prm08171 (SEQ ID NO: 4; reverse, complementary, AttB2 site in italic: 5'-ggggaccacmtgtacaa-gaaagctgggtcaaaaacaaaaataaattcco-3'), which include the AttB sites for Gateway recombination, were used for PCR amplification. PCR was performed using Hifi Taq DNA polymerase in standard conditions. A PCR fragment of the correct size was amplified and purified also using standard methods. The first step of the Gateway procedure, the BP reaction, was then performed, during which the PCR fragment recombines in vivo with the pDONR201 plasmid to produce, according to the Gateway terminology, an "entry clone", PSYR. Plasmid pDONR201 was purchased from Invitrogen, as part of the Gateway® technology.

Example 6

Vector Construction

The entry clone pSYR was subsequently used in an LR reaction with a destination vector used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice GOS2 promoter (SEQ ID NO: 5) for constitutive expression was located upstream of this Gateway cassette. A similar vector construct was prepared, but with the high mobility group protein promoter (HMGP, SEQ ID NO: 33) instead of the GOS promoter After the LR recombination step, the resulting expression vectors, pGOS2::SYR (with the GOS2 promoter) and pHMGP::SYR (with the HMGP promoter), both for constitutive SYR expression (FIG. 2) were transformed into *Agrobacterium* strain LBA4044 and subsequently to *Oryza sativa* plants.

Example 7

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivabon (to boost cell division activity).

Agrobacterium strain LBA4404 containing the expression vector was used for cocultivation. Agrobacterium was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

For transformation of other crops see Example 40.

Example 8

Evaluation Methods of Plants Transformed with SYR under the Control of the Rice GOS2 Promoter or the HMGP Promoter Evaluation Set-Up Approximately 15 to 20 independent T0 rice transformants were generated. The primary transformants were transferred from a tissue culture chamber to a greenhouse for growing and harvest of T1 seed. Eight events, of which the T1 progeny segregated 3:1 for presence/absence of the transgene, were retained. For each of these events, approximately 10 T1 seedlings containing the transgene (hetero and homo-zygotes) and approximately 10 T1 seedlings lacking the transgene (nullizygotes) were selected by monitoring visual marker expression. The selected T1 plants were transferred to a greenhouse. Each plant received a unique barcode label to link unambiguously the phenotyping data to the corresponding plant. The selected T1 plants were grown on soil in 10 cm diameter pots under the following environmental settings: photoperiod=11.5 h, daylight intensity=30,000 lux or more, daytime temperature=28° C. or higher, night time temperature=22° C., relative humidity=60-70%. Transgenic plants and the corresponding nullizygotes were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles.

Salt Stress Screen

Plants from 4 events (T2 seeds) were grown on a substrate made of coco fibers and argex (3 to 1 ratio). A normal nutrient solution was used during the first two weeks after transplanting the plantlets in the greenhouse. After the first two weeks, 25 mM of salt (NaCl) was added to the nutrient solution, until the plants were harvested.

Drought Screen

Plants from five events (T2 seeds) were grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then retransferred again to normal conditions. The rest of the cultivation (plant maturation, seed harvest) was the same as for plants not grown under abiotic stress conditions. A confirmation round was performed consisting of repeating the screen with T2 seeds not harvested from plants of the first drought screen, but from plants grown under normal conditions.

Parameters Measured

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The Areamax is the above ground area at the time point at which the plant had reached its maximal leafy biomass.

The mature primary panicles were harvested, bagged, barcode-labelled and then dried for three days in the oven at 37° C. The panicles were then threshed and all the seeds collected. The filled husks were separated from the empty ones using an air-blowing device. After separation, both seed lots were then counted using a commercially available counting machine. The empty husks were discarded. The filled husks were weighed on an analytical balance and the cross-sectional area of the seeds was measured using digital imaging. This procedure resulted in the set of the following seed-related parameters:

The flowers-per-panicle estimates the average number of florets per panicle on a plant, derived from the number of total seeds divided by the number of first panicles. The tallest panicle and all the panicles that overlapped with the tallest panicle when aligned vertically, were considered as first panicles and were counted manually. The number of filled seeds was determined by counting the number of filled husks that remained after the separation step.

The total seed yield (total seed weight) was measured by weighing all filled husks harvested from a plant. Total seed number per plant was measured by counting the number of husks harvested from a plant and corresponds to the number of florets per plant. Thousand Kernel Weight (TKW) is extrapolated from the number of filled seeds counted and their total weight. Harvest index is defined as the ratio between the total seed weight and the above-ground area (mm$^2$, multiplied by a factor 10$^8$. The parameter EmerVigor is an indication of the seedling vigour. It is calculated from the area (in mm$^2$) covered by leafy biomass in the first imaging. The seed fill rate (fillrate) is an indication of the filling of the seeds. It is expressed as a proportion (in %) of the number of filled seeds over the number of florets (nrtotalseed).

These parameters were derived in an automated way from the digital images using image analysis software and were analysed statistically. Individual seed parameters (including width, length, area, weight) were measured using a custom-made device consisting of two main components, a weighing and imaging device, coupled to software for image analysis.

Example 9

Measurement of Yield-Related Parameters for pGOS2::SYR Transformants Grown Under Normal Growth Conditions Upon analysis of the seeds as described above, the inventors found that plants transformed with the pGOS2::SYR gene construct had a higher seed yield, expressed as number of filled seeds, total weight of seeds and harvest index, compared to plants lacking the SYR transgene. The p-values show that the increases were significant. Methods for statistical analysis are as given in the introductory section to the Examples.

The results obtained for plants in the T1 generation are summarised in Table E, which represent the mean values for all the tested lines:

TABLE E

|  | % difference | p-value |
|---|---|---|
| Nr filled seeds | +47 | 0.0000 |
| Total weight seeds | +52 | 0.0000 |
| Harvest Index | +54 | 0.0000 |

The data obtained for SYR in the first experiment were confirmed in a second experiment with T2 plants. Four lines that had the correct expression pattern were selected for further analysis. Seed batches from the positive plants (both hetero- and homozygotes) in T1 were screened by monitoring marker expression. For each chosen event, the heterozygote seed batches were then retained for T2 evaluation. Within each seed batch an equal number of positive and negative plants were grown in the greenhouse for evaluation. Measurement of the seed yield parameters again showed increase in number of filled seeds, total weight of seeds and harvest index, compared to plants lacking the SYR transgene.

Example 10

Measurement of Yield-Related Parameters for pGOS2::SYR Transformants Grown Under Stress Conditions Upon analysis of the seeds as described above, the inventors found that plants transformed with the pGOS2::SYR gene construct and grown under salt stress, had a higher seed yield, expressed as number of filled seeds, total weight of seeds, fill rate and harvest index, compared to plants lacking the SYR transgene. Furthermore, these salt-stressed plants had a higher seedling vigour compared to the control plants. When the plants were grown under drought stress, the transgenic plants had a higher total weight of seeds and an increased harvest index compared to plants lacking the SYR transgene. These differences were significant, with a P value from the F test below 0.05.

Example 11

Measurement of Yield-Related Parameters for pHMGP::SYR Transformants

Similarly as for the plants transformed with the pGOS2::SYR gene construct, the inventors found that plants transformed with the pHMGP::SYR gene construct had a higher seed yield, expressed as number of filled seeds, total weight of seeds and harvest index, compared to plants lacking the SYR transgene. The p-values show that the increases were significant. The results obtained for plants in the T1 generation are summarised in Table F, which represent the mean values for all the tested lines:

TABLE F

|  | % difference | p-value |
|---|---|---|
| Nr filled seeds | +34 | 0.0000 |
| Total weight seeds | +33 | 0.0000 |
| Harvest Index | +37 | 0.0000 |

Example B

FG-GAP

Example 12

Identification of Sequences Related to SEQ ID NO: 45 and SEQ ID NO: 46

Sequences (full length cDNA, ESTs or genomic) related to SEQ ID NO: 45 and/or protein sequences related to SEQ ID NO: 46 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. The polypeptide encoded by SEQ ID NO: 45 was used for the TBLASTN algorithm, with default settings and the filter to ignore low complexity sequences set off. The output of the analysis was viewed by pairwise comparison, and ranked according to the probability score (E-value), where the score reflects the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search.

In addition to the publicly available nucleic acid sequences available at NCBI, other sequence databases may also searched following the same procedure as described above.

Table G provides a list of nucleic acid and protein sequences related to the nucleic acid sequence as represented by SEQ ID NO: 45 and the protein sequence represented by SEQ ID NO: 46.

TABLE G

Nucleic acid sequences related to the nucleic acid sequence (SEQ ID NO: 45) useful in the methods of the present invention, and the corresponding deduced polypeptides.

| Name | Source organism | Nucleic acid SEQ ID NO: | Polypeptide SEQ ID NO: | Database accession number | Status |
|---|---|---|---|---|---|
| AtFG-GAP | *Arabidopsis thaliana* | 45 | 46 | | Full length |
| AtFG-GAP homologue | *Arabidopsis thaliana* | 54 | 55 | NM_114965 | Full length |
| OsFG-GAP homologue 1 | *Oryza sativa* | 56 | 57 | NM_185137 | Full length |
| OsFG-GAP homologue 2 | *Oryza sativa* | 58 | 59 | AK068943 | Full length |
| TaFG-GAP homologue | *Triticum aestivum* | 60 | / | CK207217 | partial |
| ZmFG-GAP homologue | *Zea mays* | 61 | / | AY111316 | Partial |
| StFG-GAP homologue | *Solanum tuberosum* | 62 | / | BG598275 | Partial |
| AFG-GAP homologue | *Aquilegia* sp. | 63 | / | DT735817 | Partial |
| BnFG-GAP homologue | *Brassica napus* | 64 | / | CX192752 | Partial |
| CsFG-GAP homologue | *Citrus sinensis* | 65 | / | CX674859 | Partial |
| AoFG-GAP homologue | *Asparagus officinalis* | 66 | / | CV288972 | Partial |
| PFG-GAP homologue 1 | *Populus* sp. | 67 | / | CN520999 | Partial |
| PFG-GAP homologue 2 | *Populus* sp. | 68 | / | CX176799 | Partial |
| EeFG-GAP homologue | *Euphorbia esula* | 69 | / | DV130386 | Partial |
| CrFG-GAP homologue | *Ceratopteris richardii* | 70 | / | CV736049 | Partial |
| WmFG-GAP homologue | *Welwitschia mirabilis* | 71 | / | DT601669 | Partial |
| Ms FG-GAP homologue | *Medicago sativa* | 72 | SEQ ID NO: 73 to SEQ ID NO: 76 | | partial |

Example 13

Alignment of Relevant Polypeptide Sequences

AlignX from the Vector NTI (Invitrogen) is based on the popular Clustal algorithm of progressive alignment (Thompson et al. (1997) Nucleic Acids Res 25:4876-4882; Chema et al. (2003). Nucleic Acids Res 31:3497-3500). A phylogenetic tree may be constructed using a neighbour-joining clustering algorithm. Default values are for the gap open penalty of 10, for the gap extension penalty of 0,1 and the selected weight matrix is Blosum 62 (if polypeptides are aligned).

The result of the multiple sequence alignment using polypeptides relevant in identifying the ones useful in performing the methods of the invention is shown in FIG. 7. one can clearly see that despite some gaps in the alignment, sequence conservation is found throughout most of the protein sequence.

Example 14

Calculation of Global Percentage Identity between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table H for the global similarity and identity over the full length of the polypeptide sequences (excluding the partial polypeptide sequences). Percentage identity is given above the diagonal and percentage similarity is given below the diagonal.

The percentage identity between the polypeptide sequences useful in performing the methods of the invention can be as low as 17% amino acid identity compared to SEQ ID NO: 46.

TABLE H

MatGAT results for global similarity and identity
over the full length of the polypeptide sequences.

|   | 1 | 2 | 3 | 4 |
|---|---|---|---|---|
| 1. AtFGAP1 |  | 18.1 | 65.5 | 17.4 |
| 2. AtFGGAP2 | 31.4 |  | 17.9 | 67.7 |
| 3. OsFGGAP1 | 76.7 | 33.5 |  | 16.9 |
| 4. OsFGGAP2 | 32.8 | 83.6 | 33 |  |

Example 15

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Interpro is hosted at the European Bioinformatics Institute in the United Kingdom.

The results of the InterPro scan of the polypeptide sequence as represented by SEQ ID NO: 46 are presented in Table I.

TABLE I

InterPro scan results of the polypeptide sequence as represented by SEQ ID NO: 46

| Database | Accession number | Accession name |
|---|---|---|
| Pfam | PF01839 | FG-GAP |
| INTERPRO | IPR013517 | FG-GAP |
| INTERPRO | IPR000413 | Integrins alpha chain |

Example 16

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 46 are presented in Table J. The "plant" organism group has been selected, no cutoffs defined, and the predicted length of the transit peptide requested. The subcellular localization of the polypeptide sequence as represented by SEQ ID NO: 46 is probably not intracellular, there is a slight preference for the secretory pathway (though with a reliability score of 5) and the predicted length of the putative transit peptide is 24 amino acids starting from the N-terminus (not as reliable as the prediction of the subcellular localization itself, may vary in length of a few amino acids).

TABLE J

TargetP 1.1 analysis of the polypeptide sequence as represented by SEQ ID NO: 46

| Length (AA) | 896 |
|---|---|
| Chloroplastic transit peptide | 0.010 |
| Mitochondrial transit peptide | 0.546 |
| Secretory pathway signal peptide | 0.643 |
| Other subcellular targeting | 0.038 |
| Predicted Location | secreted |
| Reliability class | 5 |
| Predicted transit peptide length | 24 |

When analysed with SignalP (Bendtsen et al., J. Mol. Biol., 340:783-795, 2004), there is a reliable (probability of 0.998) positive identification for the presence of an N-terminal secretion signal peptide with a length of 24 amino acids. Furthermore, when using the THMM algorithm (Center for Biological Sequence Analysis, Technical University of Denmark), the protein is predicted to be located at the outer side of the cell with only a C-terminal tail in the cytoplasm: residues 1-859: outside; residues 860-879: transmembrane domain, residues 880-896: inside. Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

Example 17

Gene Cloning

The *Arabidopsis thaliana* FG-GAP gene was amplified by PCR using as template an *Arabidopsis thaliana* seedling cDNA library (Invitrogen, Paisley, UK). After reverse transcription of RNA extracted from seedlings, the cDNAs were cloned into pCMV Sport 6.0. Average insert size of the bank was 1.5 kb and the original number of clones was of the order of $1.59 \times 10^7$ cfu. Original titer was determined to be $9.6 \times 10$ cfu/ml after first amplification of $6 \times 10^{11}$ cfu/ml. After plasmid extraction, 200 ng of template was used in a 50 ul PCR mix. Primers prm06643 (SEQ ID NO: 47; sense, start codon in bold, AttB1 site in italic: 5'-ggggacaagtttgtacaaaaaagcag-gcttaaacaatgaaatctcgagcgagg-3') and prm06644 (SEQ ID NO: 48; reverse, complementary, AttB2 site in italic: 5'-ggg-gaccactttgtacaagaaagctgggtcctg tttacagatggtacctagt-3'), which include the AttB sites for Gateway recombination, were used for PCR amplification. PCR was performed using Hifi Taq DNA polymerase in standard conditions. A PCR fragment of 3.2 kb (including attB sites) was amplified and purified also using standard methods. The first step of the Gateway procedure, the BP reaction, was then performed, during which the PCR fragment recombines in vivo with the pDONR201 plasmid to produce, according to the Gateway terminology, an "entry clone", pFG-GAP. Plasmid pDONR201 was purchased from Invitrogen, as part of the Gateway® technology.

Example 18

Vector Construction

The entry clone pFG-GAP was subsequently used in an LR reaction with pGOS2, a destination vector used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice GOS2 promoter (nucleotides 1 to 2193 of SEQ ID NO: 49, the promoter-gene combination) for constitutive expression was located upstream of this Gateway cassette.

After the LR recombination step, the resulting expression vector, pGOS2::FG-GAP for FG-GAP (FIG. 7) was transformed into *Agrobacterium* strain LBA4044 and subsequently to *Oryza sativa* plants. Transformed rice plants were allowed to grow and were then examined for the parameters described in Example 19.

For transformation of other crops see Example 40.

Example 19

Evaluation Methods for Plants Transformed with FG-GAP under the Control of the rice GOS2 Promoter Approximately 15 to 20 independent T0 rice transformants were generated. The primary transformants were transferred from a tissue culture chamber to a greenhouse for growing and harvest of T1 seed. Seven events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The selected T1 plants were transferred to a greenhouse. Each plant received a unique barcode label to unambiguously link the phenotyping data to the corresponding plant. The selected T1 plants were grown on soil in 10 cm diameter pots under the following environmental settings: photoperiod=11.5 h, daylight intensity=30,000 lux or more, daytime temperature=28° C. or higher, night time temperature=22° C., relative humidity=60-70%. Transgenic plants and the corresponding nullizygotes were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The Areamax is the above ground area at the time point at which the plant had reached its maximal leafy biomass.

The mature primary panicles were harvested, bagged, barcode-labelled and then dried for three days in the oven at 37° C. The panicles were then threshed and all the seeds collected. The filled husks were separated from the empty ones using an air-blowing device. After separation, both seed lots were then counted using a commercially available counting machine. The empty husks were discarded. The filled husks were weighed on an analytical balance and the cross-sectional area of the seeds was measured using digital imaging. This procedure resulted in the set of the following seed-related parameters:

The flowers-per-panicle is a parameter estimating the average number of florets per panicle on a plant, derived from the number of total seeds divided by the number of first panicles. The tallest panicle and all the panicles that overlapped with the tallest panicle when aligned vertically, were considered as first panicles and were counted manually. The number of filled seeds was determined by counting the number of filled husks that remained after the separation step. The total seed yield (total seed weight) was measured by weighing all filled husks harvested from a plant. Total seed number per plant was measured by counting the number of husks harvested from a plant and corresponds to the number of florets per plant. Thousand Kernel Weight (TKW) is extrapolated from the number of filled seeds counted and their total weight. Harvest index is defined as the ratio between the total seed weight and the above-ground area ($mm^2$), multiplied by a factor $10^6$. These parameters were derived in an automated way from the digital images using image analysis software and were analysed statistically. Individual seed parameters (including width, length, area, weight) were measured using a custom-made device consisting of two main components, a weighing and imaging device, coupled to software for image analysis.

A two factor ANOVA (analyses of variance) corrected for the unbalanced design was used as statistical model for the overall evaluation of plant phenotypic characteristics. An F-test was carried out on all the parameters measured of all the plants of all the events transformed with that gene. The F-test was carried out to check for an effect of the gene over all the transformation events and to verify for an overall effect of the gene, also referred to herein as a "global gene effect". If the value of the F test showed that the data were significant, than it was concluded that there was a "gene" effect, meaning that it was not only presence or the position of the gene that was causing the effect. The threshold for significance for a true global gene effect was set at a 5% probability level for the F test.

To check for an effect of the genes within an event, i.e., for a line-specific effect, a t-test was performed within each event using data sets from the transgenic plants and the corresponding null plants. "Null plants" or "null segregants" or "nullizygotes" refer to plants treated in the same way as the transgenic plant, but from which the transgene has segregated. Null plants can also be described as the homozygous negative transformed plants. The threshold for significance for the t-test was set at a 10% probability level. The results for some events can be above or below this threshold. This is based on the hypothesis that a gene might only have an effect in certain positions in the genome, and that the occurrence of this position-dependent effect is not uncommon. This kind of gene effect is also referred to herein as a "line effect of the gene". The p-value was obtained by comparing the t-value to the t-distribution or alternatively, by comparing the F-value to the F-distribution. The p-value then gives the probability that the null hypothesis (i.e., that there is no effect of the transgene) is correct.

The data obtained for FG-GAP in the first experiment were confirmed in a second experiment with T2 plants. Four lines were selected for further analysis. Seed batches from the positive plants (both hetero- and homozygotes) in T1, were screened by monitoring marker expression. For each chosen event, the heterozygote seed batches were then retained for T2 evaluation. Within each seed batch an equal number of positive and negative plants were grown in the greenhouse for evaluation.

A total number of 120 FG-GAP transformed plants were evaluated in the T2 generation, that is 30 plants per event of which 15 were positive for the transgene, and 15 negative.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P-values were obtained by comparing likelihood ratio test to chi square distributions.

Example 20

Evaluation of FG-GAP Transformants

Measurement of Yield-Related Parameters

Upon analysis of the seeds as described above, the inventors found that plants transformed with the FG-GAP gene construct had a higher seed yield, expressed as number of filled seeds and total weight of seeds, compared to plants lacking the FG-GAP transgene. The p-values show that the increases were significant. Also the harvest index was increased (+9%). The results obtained for plants in the T1 generation are summarised in Table K:

TABLE K

|  | % difference | p-value of F-test |
| --- | --- | --- |
| Nr filled seeds | +19 | 0.0051 |
| Total weight seeds | +17 | 0.0199 |

These positive results were again obtained in the T2 generation. In Table L, data show the overall % increases for the number of filled seeds, total weight of seeds and harvest index, calculated from the data of the individual lines of the T2 generation, and the respective p-values. These T2 data were re-evaluated in a combined analysis with the results for the T1 generation, and the obtained p-values show that the observed effects were highly significant.

TABLE L

|  | T2 generation | | Combined analysis p-value |
| --- | --- | --- | --- |
|  | % difference | p-value of F-test |  |
| Nr filled seeds | +17 | 0.0247 | 0.0004 |
| Total weight seeds | +17 | 0.0283 | 0.0014 |
| Harvest Index | +20 | 0.0030 | 0.0007 |

Example C

CYP90B

Example 21

Gene Cloning of Oryza sativa CYP90B cDNA

The Oryza sativa CYP90B cDNA was amplified by PCR using as template an Oryza sativa seedling cDNA library (Invitrogen, Paisley, UK). After reverse transcription of RNA extracted from seedlings, the cDNAs were cloned into pCMV Sport 6.0. Average insert size of the bank was 1.6 kb and the original number of clones was of the order of $1.67 \times 10^7$ cfu. Original titer was determined to be $3.34 \times 10^6$ cfu/ml after first amplification of $6 \times 10^{10}$ cfu/ml. After plasmid extraction, 200 ng of template was used in a 50 µl PCR mix. Primers (SEQ ID NO: 107; sense, start codon in bold, AftB1 site in italic: 5' GGGGACAAGTTTGTACAAAAAAGCAG-GCTTAAACAATGGCCGCCATGATGGC 3') and (SEQ ID NO: 108; reverse, complementary, AttB2 site in italic: 5' GGGGACCACTTTGTACMGAAAGCTGGGT TTACTC-CTGCTCATCATCC 3'), which include the AttB sites for Gateway recombination, were used for PCR amplification. PCR was performed using Hifi Taq DNA polymerase in standard conditions. A PCR fragment of 1585 bp (including attB sites; from start to stop 1521 bp) was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

Example 22

Vector Construction

The entry clone was subsequently used in an LR reaction with destination vectors used for Oryza sativa transformation. These vectors contain as functional elements within the T-DNA borders: a plant selectable marker; a screenable marker expression cassette; and a Gateway cassette intended for LR in vivo recombination with the sequence of interest already cloned in the entry clone. Four different rice promoters located upstream of this Gateway cassette were used to express the Otyza saliva CYP90B: prolamin RP6, oleosin 18 kDa, GOS2 and HMGB1.

After the LR recombination step, the resulting expression vectors (prolamin RP6 promoter, oleosin 18 kDa, GOS2 and HMGB1—see FIG. 14) were transformed into Agrobacterium strain LBA4044 and subsequently to Oryza sativa plants. Transformed rice plants were allowed to grow and were then examined for the parameters described in the Examples below. For transformation of other crops see Example 40.

Example 23

Description of the Phenotypic Evaluation Procedure

Approximately 15 to 20 independent T0 rice transformants were generated per construct. The primary transformants were transferred from a tissue culture chamber to a greenhouse for growing and harvest of T1 seed. Four or five events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the suitable control plants were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles.

Three T1 events were further evaluated in the T2 generation following the same evaluation procedure as for the T1 generation but with more individuals per event.

Seed-Related Parameter Measurements

The mature primary panicles were harvested, counted, bagged, barcode-labeled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand kernel weight (TKW) is extrapolated from the number of filled seeds counted and their total weight. The harvest index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets). Individual seed parameters (width, length and area) were measured using a custom-made device consisting of two main components, a weighing and imaging device, coupled to software for image analysis. Both husked and dehusked seeds were used for these measurements.

Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and for an overall effect of the gene, also known as a global gene effect. The threshold for significance for a true global gene effect was set at a 5% probability level for the F-test. A significant F-test value points to a gene effect, meaning that it is not only the presence or position of the gene that is causing the differences in phenotype.

Example 24

Results of *Oryza sativa* CYP90B under the Control of Non-Constitutive Promoters 24.1 Transgenic plants expressing CYP90B under the control of the endosperm-specific promoter The seed yield and HI measurement results for transgenic plants expressing CYP90B under the control of the endosperm-specific (prolamin RP6) promoter are shown in Table M and N, respectively. The number of events with an increase is indicated, as well as the p values from the F test for the T1 and T2 generations.

TABLE M

Seed yield measurement results of transgenic plants expressing CYP90B under the control of the endosperm-specific promoter.

| | Number of events showing an increase | % Difference | P value of F test |
|---|---|---|---|
| T1 generation | 3 out of 4 | 11 | 0.1572 |
| T2 generation | 3 out of 3 | 13 | 0.0103 |

TABLE N

HI measurement results of transgenic plants expressing CYP90B under the control of the endosperm-specific promoter.

| | Number of events showing an increase | % Difference | P value of F test |
|---|---|---|---|
| T1 generation | 4 out of 4 | 11 | 0.047 |
| T2 generation | 3 out of 3 | 10 | 0.0392 |

The transgenic rice plants expressing CYP90B under the control of the endosperm-specific (prolamin RP6) promoter present an increased harvest, due to an increase in seed yield while aboveground plant biomass remains unchanged (data not shown), when compared to control plants.

24.2 Transgenic Plants Expressing CYP90B under the Control of the Embryo/Aleurone-Specific Promoter The TKW measurement results for transgenic plants expressing CYP90B under the control of an embryo/aleurone (oleosin 18 kDa) promoter are shown in Table 0. The number of events with an increase is indicated as well as the p values from the F test for the T1 and T2 generations.

TABLE O

TKW measurement results of transgenic plants expressing CYP90B under the control of the embryo/aleurone promoter.

| | Number of events showing an increase | % Difference | P value of F test |
|---|---|---|---|
| T1 generation | 5 out of 5 | 4 | 0.0002 |
| T2 generation | 2 out of 3 | 1 | 0.2428 |

The average seed area measurement results for transgenic plants expressing CYP90B under the control of the oleosin 18 kDa promoter are shown in Table P. The number of events with an increase is indicated as well as the p values from the F test for the T1 and T2 generations.

TABLE P

Average seed area measurement results of transgenic plants expressing CYP90B under the control of the embryo/aleurone promoter.

| | Number of events showing an increase | % Difference | P value of F test |
|---|---|---|---|
| T1 generation | 5 out of 5 | 3 | <0.0001 |
| T2 generation | 3 out of 3 | 2 | 0.0272 |

The average seed length measurement results for transgenic plants expressing CYP90B under the control of the oleosin 18 kDa promoter are shown in Table Q. The number of events with an increase is indicated as well as the p values from the F test for the T1 and T2 generations.

TABLE Q

Average seed length measurement results of transgenic plants expressing CYP90B under the control of the embryo/aleurone promoter.

| | Number of events showing an increase | % Difference | P value of F test |
|---|---|---|---|
| T1 generation | 5 out of 5 | 3 | <0.0001 |
| T2 generation | 3 out of 3 | 1 | 0.0086 |

Transgenic rice plants expressing CYP90B under the control of an embryo/aleurone (oleosin 18 kDa) promoter have seeds with increased TKW, seed area and seed length. No significant increase in seed yield was observed.

Example 25

Evaluation and Results of *Oryza sativa* CYP90B under the Control of Constitutive Promoters 25.1 Transgenic Plants Expressing CYP90B under the Control of the GOS2 Constitutive Promoter The evaluation measurement results for transgenic plants expressing CYP90B under the control of the GOS2 constitutive promoter are shown in Table R. The number of events with an increase is indicated, as well as the p values from the F test for the T1 generation. No T2 generation evaluation is performed when negative results are obtained in the T1 generation.

TABLE R

Evaluation measurement results of transgenic plants expressing CYP90B under the control of the GOS2 constitutive promoter.

| | Number of events showing an increase | % Difference | P value of F test |
|---|---|---|---|
| Aboveground biomass | 5 out of 5 | −13 | <0.0001 |
| Height | 5 out of 5 | −7 | <0.0001 |
| Number of filled seeds | 5 out of 5 | −53 | <0.0001 |
| Number of seeds | 5 out of 5 | −32 | <0.0001 |
| Seed yield | 5 out of 5 | −53 | <0.0001 |
| HI | 5 out of 5 | −46 | <0.0001 |

25.2 Transgenic Plants Expressing CYP90B under the Control of the HMBG1 Constitutive Promoter The evaluation measurement results for transgenic plants expressing CYP90B under the control of the HMGB1 constitutive promoter are shown in Table S. The number of events with an increase is indicated, as well as the p values from the F test for the T1 generation. No T2 generation evaluation is performed when negative results are obtained in the T1 generation.

TABLE S

Evaluation measurement results of transgenic plants expressing CYP90B under the control of the HMGB1 constitutive promoter.

| | Number of events showing an increase | % Difference | P value of F test |
|---|---|---|---|
| Aboveground biomass | 5 out of 5 | −18 | <0.0001 |
| Height | 5 out of 5 | −6 | <0.0001 |
| Number of filled seeds | 5 out of 5 | −56 | <0.0001 |
| Number of seeds | 5 out of 5 | −33 | <0.0001 |
| Seed yield | 5 out of 5 | −56 | <0.0001 |
| HI | 5 out of 5 | −46 | <0.0001 |

Transgenic rice plants expressing CYP90B under the control of two different constitutive promoters show strongly reduced aboveground plant biomass, plant height, number of filled seeds, seed yield and HI compared to control plants.

Example D

CDC27

Example 26

Cloning of an *Arabidopsis thaliana* Gene Encoding a CDC27 Polypeptide having at Least One Inactive TPR Domain in the $NH_2$ Terminal Region of the Polypeptide The *Arabidopsis thaliana* gene encoding a CDC27 polypeptide having at least one inactive TPR domain in the $NH_2$ terminal region of the polypeptide (COS0171_2) was amplified by PCR using as template an *Arabidopsis thaliana* seedling cDNA library (Invitrogen, Paisley, UK). After-reverse transcription of RNA extracted from seedlings, the cDNAs were cloned into pCMV Sport 6.0. Average insert sie of the bank was 1.5 kb and the original number of clones was of the order of $1.59 \times 10^7$ cfu. Original titer was determined to be $9.6 \times 10^6$ cfu/ml, and after the first amplification of 101° cfu/ml. After plasmid extraction, 200 ng of template was used in a 50 µl PCR mix. Primers (SEQ ID NO: 149; sense, start codon in bold, AttB1 site in italic: 5'-GGGGACMGTTTG-TACAAAAAAGCAGGCTTCACAATGCMCM-CTGTCMCTTC 3') and (SEQ ID NO: 150; reverse, complementary, AttB2 site in italic: 5' GGGGACCACTTTGTA CAAGAAAGCTGGGTTGGAGTAGCTATGGTTITCAC-3'), which include the AttB sites for Gateway recombination, were used for PCR amplification. PCR was performed using Hifi Taq DNA polymerase in standard conditions. A PCR fragment of 1816 bp (including attB sites; from start to stop 1737 bp) was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

Example 27

Vector Construction

The entry clone was subsequently used in an LR reaction with a destination vector used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice OSH1 promoter (SEQ ID NO: 151) for shoot apical meristem expression was located upstream of this Gateway cassette.

After the LR recombination step, the resulting expression vector shown in FIG. 18 was transformed into *Agrobacterium* strain LBA4044 and subsequently to *Oryza* saliva plants. Transformed rice plants were allowed to grow and were then examined for the parameters described in Examples 28 and 29. For transformation of other crops see Example 40.

Example 28

Description of the Phenotypic Evaluation Procedure

Approximately 15 to 20 independent T0 rice transformants were generated. The primary transformants were transferred from a tissue culture chamber to a greenhouse for growing and harvest of T1 seed. Five events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the suitable control plants were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles. Three of the events evaluated in T1 were further evaluated in the T2 generation following the same evaluation procedure as for the T1 generation but with more individuals per event.

Seed-Related Parameter Measurements

The mature primary panicles were harvested, counted, bagged, barcode-labeled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand kernel weight (TKW) is extrapolated from the number of filled seeds counted and their total weight. The harvest index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and for an overall effect of the gene, also known as a global gene effect. The threshold for significance for a true global gene effect was set at a 5% probability level for the F-test. A significant F-test value points to a gene effect, meaning that it is not only the presence or position of the gene that is causing the differences in phenotype.

Example 29

Results of the Evaluation of Transgenic Rice Plants Expressing a Modified *Arabidopsis thaliana* CDC27 Nucleic Acid under the Control of a Shoot Apical Meristem Promoter The evaluation measurement results (seed yield, number of filled seeds, and HI) for transgenic plants expressing a modified CDC27 nucleic acid under the control of a shoot apical meristem promoter (OSH1) are shown in Tables T to V. The number of events with an increase, the % difference with suitable control plants, as well as the p values from the F test for the T1 and T2 generations are indicated.

TABLE T

Seed yield measurement results of transgenic plants expressing a modified CDC27 nucleic acid under the control of a shoot apical meristem promoter.

| | Number of events showing an increase | % Difference | P value of F test |
|---|---|---|---|
| T1 generation | 3 out of 5 | 35 | 0.0113 |
| T2 generation | 2 out of 3 | 11 | 0.0083 |

TABLE U

Number of filled seeds measurement results of transgenic plants expressing a modified CDC27 nucleic acid under the control of a shoot apical meristem promoter.

| | Number of events showing an increase | % Difference | P value of F test |
|---|---|---|---|
| T1 generation | 3 out of 5 | 36 | 0.0083 |
| T2 generation | 2 out of 3 | 10 | 0.0099 |

TABLE V

Harvest index measurement results of transgenic plants expressing a modified CDC27 nucleic acid under the control of a shoot apical meristem promoter.

| | Number of events showing an increase | % Difference | P value of F test |
|---|---|---|---|
| T1 generation | 3 out of 5 | 34 | 0.0053 |
| T2 generation | 2 out of 3 | 6 | 0.0188 |

Transgenic rice plants expressing a modified CDC27 nucleic acid under the control of shoot apical meristem promoter have significantly increased seed yield, increased number of filled seeds and increased harvest index.

Example E

AT-Hook

Example 30

Gene Cloning of *Oryza sativa* A T-Hook-Encoding Nucleic Acid

The *Oryza sativa* gene encoding a polypeptide comprising an AT-hook domain and a DUF296 domain (see SEQ ID NO: 152) was amplified by PCR using as template an Ofyza saliva seedling cDNA library (Invitrogen, Paisley, UK). After reverse transcription of RNA extracted from seedlings, the cDNAs were cloned into pCMV Sport 6.0. Average insert size of the bank was 1.6 kb and the original number of clones was of the order of $1.67 \times 10^7$ cfu.-Original titer was determined to be $3.34 \times 10^8$ cfu/ml after first amplification of $6 \times 10^{10}$ cfu/ml. After plasmid extraction, 200 ng of template was used in a 50 µl PCR mix. Primers (SEQ ID NO: 196; sense, AttB1 primer: 5'-ggggacaagtttgtacaaaaaagcaggcttaaacaatggatccggtcacgg-3') and (SEQ ID NO: 197; reverse, complementary, AttB2 primer 5'-ggggaccactttgtacaa-gaaagctgggtggaatcgatccatctcagaa-3'), which include the AttB sites for Gateway recombination, were used for PCR amplification. PCR was performed using Hifi Taq DNA polymerase in standard conditions. A PCR fragment (including aftB sites; from start to stop) was amplified and purified using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Example 31

Vector Construction

The entry clone was subsequently used in an LR reaction with a destination vector containing the prolamin promoter used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice prolamin promoter (SEQ ID NO: 195) for endosperm-specific expression was located upstream of this Gateway cassette.

After the LR recombination step, the resulting expression vector shown in FIG. 22 was transformed into *Agrobacterium* strain LBA4044 and subsequently to *Oryza saliva* plants. Transformed rice plants were allowed to grow and were then examined for the parameters described below. For transformation of other crops see Example 40.

Example 32

Evaluation and Results

Approximately 15 to 20 independent T0 rice transformants were generated. The primary transformants were transferred from a tissue culture chamber to a greenhouse for growing and harvest of T1 seed. Seven events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression.

32.1 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and for an overall effect of the gene (also referred to as a global gene effect). The threshold for significance for a true global gene effect was set at a 5% probability level for the F-test. A significant F-test value points to a gene effect, meaning that it is not only the presence or position of the gene that is causing the differences in phenotype.

32.2 Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand kernel weight (TKW) was extrapolated from the number of filled seeds counted and their total weight. The harvest Index (HI) was expressed as a ratio between the total seed yield and the aboveground area ($mm^2$), multiplied by a factor $10^6$. The total number of flowers per panicle was expressed as a ratio between the total number of seeds and the number of mature primary panicles. The seed fill rate was expressed as a % of the number of filled seeds over the total number of seeds (or florets).

TABLE W

Comparative data to showing the difference in seed yield obtained using an endosperm-specific promoter (prolamin) compared with a root-specific promoter (RCc3 promoter)

| CDS3129 = SEQIDNO 1/2 | | | Total weight | Number filled seeds | Flowers per panicle | Harvest index | Number total seeds |
|---|---|---|---|---|---|---|---|
| root-specific promoter | 4 events | % difference | 9.20% | 10.00% | 0.00% | 11.20% | 0.00% |
| | | p No of F-test | 0.0451 | 0.0266 | 0.7744 | 0.0027 | 0.4410 |
| endosperm specific promoter | 5 events | % difference | 46.10% | 48.50% | 16.40% | 39.40% | 19.50% |
| | | p No of F-test | <0.0001 | <0.0001 | <0.0001 | <0.0001 | <0.0001 |

The table shows the % difference in various parameters for transgenic plants compared to corresponding control plants (nullizygotes); also shown in the Table is the p value from the F-test which indicates the overall effect of the gene. As shown in the table, various seed yield parameters were increased in plants expressing an AT-hook-encoding nucleic acid (SEQ ID NO: 152) under the control of an endosperm-specific promoter, whereas no increase (in fact a significant decrease) was obtained for plants expressing the same transgene under the control of a root-specific promoter in transgenic plants.

Example F

DOF Transcription Factors

Example 33

Gene Cloning of *Arabidopsis Thaliana* DOF Transcription Factor (SEQ ID NO: 198)

The *Arabidopsis thaliana* DOF transcription factor gene was amplified by PCR using as template an *Arabidopsis thaliana* seedlirig cDNA library (Invitrogen, Paisley, UK).

After reverse transcription of RNA extracted from seedlings, the cDNAs were cloned Into pCMV Sport 6.0. Average insert size of the bank was 1.5 kb and original number of clones was of 1.59×10⁷ cfu. Original titer was determined to be 9.6×10⁵ cfu/ml after first amplification of 6×10¹1 cfu/ml. After plasmid extraction, 200 ng of template was used in a 50 μl PCR mix. Primer (SEQ ID NO: 223) (sense AttB1 primer: 5' ggg-gacaagtttgtacaaaaaa gcaggcttaaacaatgggtggatcgatggc 3') and (SEQ ID NO: 224) (reverse complementary AttB2 primer 5' ggggaccactttgtacaagaaagctgggtcgttaatgatccgacaaaaca 3'), which include the AttB sites for Gateway recombination, were used for PCR amplification. PCR was performed using Hifi Taq DNA polymerase in standard conditions. A PCR fragment (including attB sites; from start to stop) was amplified and purified also using standard methods. The first step of the Gateway procedure, the BP reaction, was then performed during which the PCR fragment recombined in vivo with the pDONR201 plasmid to produce, according to the Gateway terminology, an "entry clone". Plasmid pDONR201 was purchased from Invitrogen, as part of the Gateway® technology.

Example 33a

Vector Construction

The entry clone was subsequently used in an LR reaction with a destination vector containing GOS2 used for *Oryza sativa* transformation. This vector contained as functional elements within the T-DNA borders: a plant selectable marker; a screenable marker expression cassette; and a Gateway cassette intended for LR in vivo recombination with the sequence of interest already cloned in the entry clone. A rice GOS2 promoter (SEQ ID NO: 225) for constitutive expression was located upstream of this Gateway cassette.

After the LR recombination step, the resulting expression vector shown in FIG. 26 was transformed into *Agrobacterium* strain LBA4044 and subsequently to *Oryza sativa* plants. Transformed rice plants were allowed to grow and were then examined for the parameters described below. For transformation of other crops see Example 40.

Example 34

Gene Cloning of *Arabidopsis Thaliana* DOF Transcription Factor (SEQ ID NO: 226)

The *Arabidopsis thaliana* DOF transcription factor gene was amplified by PCR using as template an *Arabidopsis thaliana* seedling cDNA library (Invitrogen, Paisley, UK). After reverse transcription of RNA extracted from seedlings, the cDNAs were cloned into pCMV Sport 6.0. Average insert size of the bank was 1.5 kb and original number of clones was of 1.59×10⁷ cfu. Original titer was determined to be 9.6×10⁵ cfu/ml after first amplification of 6×10¹¹ cfu/ml. After plasmid extraction, 200 ng of template was used in a 50 μl PCR mix. Primer (SEQ ID NO: 256) (sense AttB1 primer 5' ggg-gacaagtttgtacaaaaaa gcaggcttaaacaatgatgatggagactagagatc3') and (SEQ ID NO: 257) (reverse complementary AttB2 primer 5' ggggaccactttgtacaagaaagctgggtcatatgtaactctaaatctgttca3'), which include the AttB sites for Gateway recombination, were used for PCR amplification. PCR was performed using Hifi Taq DNA polymerase in standard, conditions. A PCR fragment (including attB sites; from start to stop) was amplified and purified also using standard methods. The first step of the Gateway procedure, the BP reaction, was then performed during which the PCR fragment recombined in vivo with the pDONR201 plasmid to produce, according to the Gateway terminology, an "entry clone". Plasmid pDONR201 was purchased from Invitrogen, as part of the Gateway) technology.

Example 34a

Vector Construction

The entry clone was subsequently used in an LR reaction with a destination vector containing prolamin used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice prolamin promoter (SEQ ID NO: 258) for seed-specific expression was located upstream of this Gateway cassette.

After the LR recombination step, the resulting expression vector shown in FIG. 27 was transformed into *Agrobacterium* strain LBM044 and subsequently to *Oryza sativa* plants. Transformed rice plants were allowed to grow and were then examined for the parameters described below. For transformation of other crops see Example 40.

Example 35

Evaluation and Results

Approximately 15 to 20 independent T0 rice transformants were generated. The primary transformants were transferred from a tissue culture chamber to a greenhouse for growing and harvest of T1 seed. Seven events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. Approximately 4 T1 events were further evaluated in the T2 generation following the same evaluation procedure as for the T1 generation but with more individuals per event.

Plants from five events were grown under normal conditions until the heading stage. Soil moisture was monitored continuously using moisture sensors inserted in the pots of several randomly chosen non-transgenic control plants. In a first phase, the pots were saturated to a maximum value of 60% to reduce the pot-to-pot variability. Once the pots were saturated, irrigation was withheld until a soil-moisture content of below 20% was obtained. The plants were then re-watered until the soil moisture reached the maximum level of 60% again. The plants were then imaged to evaluate the following root-related and seed-related parameters.

Root-Related Parameters

Plants were grown in specially designed pots with transparent bottoms to allow visualization of the roots. A digital camera recorded images through the bottom of the pot during plant growth. Root features such as total projected area (which can be correlated to total root volume), average diameter and length of roots above a certain thickness threshold (length of thick roots, or length of thin roots) were deduced from the generated image using appropriate software.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand kernel weight (TKW) was extrapolated from the number of filled seeds counted and their total weight. The harvest index (HI) In the present invention is defined as the ratio between the total seed yield and the above ground area (mm$^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and for an overall effect of the gene, also known as a global gene effect. The threshold for significance for a true global gene effect was set at a 5% probability level for the F-test. A significant F-test value points to a gene effect, meaning that it is not only the presence or position of the gene that is causing the differences in phenotype.

Table X below shows the results of the T2 evaluation for transgenic plants expressing a nucleic acid encoding a DOF transcription factor under the control of a GOS2 promoter and the results of the T2 evaluation for transgenic plants expressing a nucleic acid encoding a DOF transcription factor under the control of a prolamin promoter. Although not shown, comparable results were obtained for T1 plants). The p-value from the F test is shown for the parameters listed in the table, as well as the percentage difference between transgenic plants verses nullizygotes.

In addition to the abovementioned seed-related parameters, the following root parameters also were increased in transgenic plants compared to nullizygotes: 14% increase in total root biomass, 7% increase in number of thin roots (internal threshold), 36% increase in number of thick roots (internal threshold) and an 8% increase in average diameter of roots.

The aforementioned results were obtained under conditions of mild drought stress; similar results would be expected under normal or non-stress conditions.

Example G

CKI

Example 36

Cloning of an *Oryza Sativa* Gene Encoding an CKI4 Polypeptide

The *Oryza sativa* gene encoding a CKI4 polypeptide was amplified by PCR using as template an *Oryza sativa* cell suspension culture cDNA library cloned in the pAD-Gal4-2.1 vector of HybriZAP-2.i kit (Stratagene, La Jolla, Calif. USA), according to the manufacturer's instructions. Average insert size of the bank was 1.5 kb and the original number of clones was of the order of 2×10$^8$ pfu. Original titer was determined to be 4×10$^6$ pfu/ml and after the first amplification of 1010 pfu/ml. After plasmid extraction, 200 ng of template was used in a 50 µl PCR mix. Primers (SEQ ID NO: 284; sense, start codon in bold, AttB1 site in italic: 5'-*GGGGACMGTTTG-TACAAAAAGCAGGCTTCA*-CAATGGGCAAGTACATGCGCAAGGCC-3') and (SEQ ID NO: 285; reverse, complementary, AttB2 site in italic: (5'-*GGGGACCACTTTGTACAA-GAAAGCTGGGT*GGAGCAGAGAGGTC-CATGGTGCCC-3'), which include the AttB sites for Gateway recombination, were used for PCR amplification. PCR was performed using Hifi Taq DNA polymerase in standard conditions. A PCR fragment of 662 bp (including attB sites;

TABLE X

| | Results of T2 Evaluation | | | | | | | |
|---|---|---|---|---|---|---|---|---|
| | Total seed Weight | | Number of Filled Seeds | | Harvest Index | | Fill Rate | |
| | % Difference | P-Value | % Difference | P-Value | % Difference | P-Value | % Difference | P-Value |
| Example 1 (GOS2) [Internal reference CD12148; CDS3325] | 34.0% | 0.0070 | 36.0% | 0.0061 | 32% | 0.0032 | 21% | 0.0011 |
| Example 2 (prolamin) [Internal reference CD12225; CDS3319] | 18% | 0.0348 | 17% | 0.0385 | 19% | 0.035 | 12% | 0.1373 | from start to stop 585 bp) was amplified and purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

Example 37

Vector Construction

The entry clone was subsequently used in an LR reaction with a destination vector used for *Oryza sativa* transformation. This vector contains as functional elements within the T-DNA borders: a plant selectable marker; a screenable marker expression cassette; and two Gateway cassettes in opposite orientation intended for LR in vivo recombination with the sequence of interest already cloned in the entry clone. The two Gateway cassettes were separated by non-coding DNA (in this case a 315 bp fragment of a tobacco matrix attachment region (MAR), NCBI reference U67919, fragment from 774 to 1088 bp), to promote formation of a hairpin structure of the mRNA after transcription. A rice RP6 prolamin promoter (SEQ ID NO: 281) for endosperm-specific expression was located upstream of the first Gateway cassette, in opposite orientation with respect to the promoter.

The entry clone was also used in an LR reaction with another destination vector used for *Oryza sativa* transformation. This vector was identical to the one described above, except that the RP6 prolamin promoter had been replaced with rice beta-expansin promoter of SEQ ID NO: 282.

After the LR recombination step, the two resulting expression vectors (FIG. 32 for both vectors) were transformed into *Agrobacterium* strain LBA4044 and subsequently to *Oryza sativa* plants. Transformed rice plants were allowed to grow and were then examined for the parameters described in Examples 38 and 39. For transformation of other crops see Example 40.

Example 38

Description of the Phenotypic Evaluation Procedure

Approximately 15 to 20 independent T0 rice transformants were generated. The primary transformants were transferred from a tissue culture chamber to a greenhouse for growing and harvest of T1 seed. Four to five events, of which the T1 progeny segregated 3:1 for presence/absence of the transgene, were retained. For each of these events, approximately 10 T1 seedlings containing the transgene (hetero- and homozygotes) and approximately 10 T1 seedlings lacking the transgene (nullizygotes) were selected by monitoring visual marker expression. The transgenic plants and the suitable control plants were grown side-by-side at random positions. From the stage of sowing until the stage of maturity the plants were passed several times through a digital imaging cabinet. At each time point digital images (2048×1536 pixels, 16 million colours) were taken of each plant from at least 6 different angles.

The same events evaluated in T1 were further evaluated in the T2 generation following the same evaluation procedure as for the T1 generation.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step.

The total seed yield was measured by weighing all filled husks harvested from a plant. Total seed number per plant was measured by counting the number of husks harvested from a plant. The harvest index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and for an overall effect of the gene, also known as a global gene effect. The threshold for significance for a true global gene effect was set at a 5% probability level for the F-test. A significant F-test value points to a gene effect, meaning that it is not only the presence or position of the gene that is causing the differences in phenotype.

Example 39

Results of the Evaluation of Transgenic Rice Plant with Reduced CKI4 Expression in the Endosperm The evaluation measurement results (seed yield, number of filled seeds, total number of seeds and flowers per panicle) for transgenic plants with reduced CKI4 expression in the endosperm are presented in Table Y below. The number of plants with an increase in a parameter, the average percentage increase as well as the P value of the T2 generation are shown, and compared to results obtained with transgenic plants with reduced CKI4 expression using a beta expansin promoter for preferential expression in shoot tissue.

The results show that reduced expression of CKI4 in the endosperm gives plants with significantly increased seed weight, number of filled seeds, total number of seeds and flowers per panicle, compared to nullizygotes and compared to transgenic plants with preferentially reduced expression of CKI4 in shoot tissue (using a beta expansin promoter).

TABLE Y

Evaluation measurement results for transgenic plants with reduced CKI4 expression in the endosperm

| | Endosperm-specific promoter | | | Shoot-specific promoter % increase |
|---|---|---|---|---|
| | Number of plants with increased parameter | % increase | P value | |
| Seed Yield | 4 out of 4 | 17% | 0.006 | <17% |
| Number of filled seeds | 4 out of 4 | 19% | 0.0018 | <19% |
| Total number of seeds | 4 out of 4 | 16% | 0.0014 | <16% |
| Flowers per panicle | 3 out of 4 | 9% | 0.006 | <9% |

Example 40

Transformation of Corn, Wheat, Soybean, Rapeseed and Alfalfa

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M patent U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MSO) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 μm J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L $K_2SO_4$, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

SEQUENCE LISTING (317 sequences)

SEQ ID NO: 1 - DNA, 353 bp, Oryza sativa
atggaaggtgtaggtgctaggcagaggaggaaccctctgatacccagaccaaacggttcaaagaggcatctgcagcatcagcatcagccaaatgctgccgagaagaagaccgccgcgacatcgaattacttcagtatcgaggcgttcctcgtgctcgtcttcctcaccatgtcattgctcatacttccattggtgcttcccccattgcctccgccgccatcgctgctgctgctgctgccagtctgcctgctcatcctgctggttgtgctggccttcatgccaacggatgtgcggagcatggcttcctcttacttgtaaatacatctcctaggggaatttatttttgtttttga

SEQ ID NO: 2 - protein, 105 aa, Oryza sativa
MEGVGARQRRNPLIPRPNGSKRHLQHQHQPNAAEKKTAATSNYFSIEAFLVLVFLTMSLLILPLVLPPLPPPPSLLLLLPVCLLILLVVLAFMPTDVRSMASSYL

SEQ ID NO: 3 - DNA, 56 bp, Artificial sequence
  primer: prm08170
ggggacaagtttgtacaaaaaagcaggcttaaacaatggaaggtgtaggtgctagg

SEQ ID NO: 4 - DNA, 51 bp, Artificial sequence
  primer: prm08171
ggggaccactttgtacaagaaagctgggtcaaaaacaaaaataaattcccc

SEQ ID NO: 5 - DNA, 2193 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 6 - protein, 3 aa, Artificial sequence
  conserved motif 1a
YFS

SEQ ID NO: 7 - protein, 3 aa, Artificial sequence
  conserved motif 1b
YFT

SEQ ID NO: 8 - protein, 3 aa, Artificial sequence
  conserved motif 1c
YFG

SEQ ID NO: 9 - protein, 3 aa, Artificial sequence
  conserved motif 1d
YLG

SEQ ID NO: 10 - protein, 7 aa, Artificial sequence
  conserved motif 2
  VARIANT (1)..(1): Xaa is Ala, Ile, or Val
  VARIANT (7)..(7): Xaa is Ser or Thr
XLAFMPX

SEQ ID NO: 11 - protein, 3 aa, Artificial sequence
  conserved motif 3
  VARIANT (1)..(1): Xaa is Pro or Ser
XYL

SEQ ID NO: 12 - protein, 178 aa, Oryza sativa
MYLLSPRNGDEEDEQEEIQELISDDEPPNLKLASCATAASSSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTTTSSSSSAGGGGGGGRNGATTGHAPYL

SEQ ID NO: 13 - protein, 126 aa, Oryza sativa
MLLEHLMITMEEQMFREQQMQRGGRHHQHHTTREQEQQQKQQQRRRLMNNATNGGGGDGGSRCYFSTEAILVLACVTVSLLVLPLILPPLPPPPTLLLLLPVCLLALLVVLAFMPTDMRTMASSYL

SEQ ID NO: 14 - protein, 105 aa, Zea mays
  UNSURE (65)..(75): Xaa can be any naturally occurring amino acid
MASRSSAMEGGAAIQRRNAVKRHLQQRQQEADFLDKKVIASTYFSIGAFLVLACLTVSLLILPLXXXXXXXXXXXLLWLPVCLLVLLVVLAFMPTDVRSMASSYL

SEQ ID NO: 15 - protein, 110 aa, Triticum aestivum
MDSQFGALERGGSRQRRSPVLARPNTTKRHIQQQRANAADKKVVMPNYFSIEAFFVLACLTVSLLILPLVLPPLPPPPSLLLFVPVCLLILLMVLAFMPTDMRSMATSYL

SEQ ID NO: 16 - protein, 110 aa, Hordeum vulgare
MDSQFGAMDRGGSRQRSSPVLARPNTAKRQMQQQRANAADKKVVIPNYFGVEAFFVLACLTVSLLILPLVLPPLPPPPSLLLLLPVCLLILLMVLAFMPTDVRSMATSYL

SEQ ID NO: 17 - protein, 99 aa, Saccharum officinarum
  UNSURE (62)..(62): Xaa can be any naturally occurring amino acid
MEGGGQIQRRNNAVKRHLQQRQQEADFLDKKVIASTYFSIEAFLVLACLTVSLLILPLVLPXLPAPASLLLWLPVWLLELLIVLAFMPTDVRSMASSYL

SEQ ID NO: 18 - protein, 99 aa, Saccharum officinarum
MEGGGQIQRRNNAVKRHLQQRQQEADFLDKKVIASTYFSIEAFLVLACLTVSLLILPLVLPPLPPPPSLLLWLPVCLLILLIVLAFMPTDVRSMASSYL

SEQ ID NO: 19 - protein, 107 aa, Sorghum bicolor
MASRSSALEGGGAAIQRRNNAVKRHLQQRQQEADFHDKKVIASTYFSIGAFLVLACLTFSLLILPLVLPPLPPPPSLLLWLPVCLLVLLVVLAFMPTDVRSVAASYL

SEQ ID NO: 20 - protein, 130 aa, Arabidopsis thaliana
MIREISNLQKDIINIQDSYSNNRVMDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 21 - protein, 135 aa, Arabidopsis thaliana
MIREFSSLQNDIINIQEHYSLNNNMDVRGDHNRKNTSFRGSAPAPIMGKQELFRTLSSQNSPRRLISASYFSLESMVVLVGLTASLLILPLILPPLPPPPFMLLLIPIGIMVLLMVLAFMPSSNSKHVSSSSTFM

SEQ ID NO: 22 - protein, 139 aa, Vitis vinifera
MSIEQPEADSRLSEGPLINLQDRYLSGIMEARGRRNSAPLQVERKNPTPPMAEGKKMEYNRTPLSRENSRRLIPASYFSLESLLLLICLTASLLILPLILPPLPPPPFMLLLLPIGILAVLMILAFMPSNVRDLTYTYV

SEQ ID NO: 23 - protein, 126 aa, Citrus sp.
  UNSURE (103)..(103): Xaa can be any naturally occurring amino acid
MNSDNSESRQRLSKGIINLQDRYPTSIMDRGVRKIATPPVEKRKVEYHRSYSQGASRKLFSASYFTLESLLLLVCLTASLLILPLVLPPLPPPPFLLLLVPIXILAVLLVLAFMPSNVRDITSTYV

SEQ ID NO: 24 - protein, 118 aa, Lycorpersicon esculentum
MNMDMESSEAKLRSSKGFINLEEHQQYFNNIMEGNKMEHKRSFTQGHGKKMLSMNYFSLESIILLLGLTASLLLLPLMLPPLPPPPFMLLLVPIFILVVLMILAFMPSNVRNVTCSYL

SEQ ID NO: 25 - protein, 87 aa, Lycorpersicon esculentum
MEGNKMEHKRSFTQGHGKKMLSMNYFSLESIILLLGLTASLLLLPLMLPPLPPPPFMLLLVPIFILVVLMILAFMPSNVRNVTCSYL

SEQ ID NO: 26 - protein, 106 aa, Arabidopsis thaliana
MDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 27 - DNA, 537 bp, Oryza sativa
atgtacttgttgagcccaagaaatggcgacgaggaggacgaacaggaggaaatccaggagctgatcagcgacgacgagccgcccaatctcaagttggcatcctgcgccactgcagccagcagcagcagcagcagcggcagcgacatggagaagggaagaggtaaagcctgcggcggcgggagtacggcgccgccgccgccgccgccgtcgtcgtcaggtaaatccggcggcggcggcggcagcaatatcagggaggcggcggctagcggcggcggcggcggcgtgtggggcaagtacttctcggtggagtcgctgctcctgctggtgtgcgtgacggcgtcgctggtgatcctcccgctcgtgctgccgccgctgcccccgccgccgtcgatgctgatgctggtgccggtggcgatgctggtgctgctgctggcgctggcgttcatgccgacgacgacgtcgtcgtcgtcgtccgccggcggcggcggcggcggcggccgcaatggggcgacgacgggacatgctccctacttgtag

SEQ ID NO: 28 - DNA, 538 bp, Zea mays
  misc_feature (177)..(208): n is a, c, g, or t
  misc_feature (493)..(493): n is a, c, g, or t
ttcacattacactcatgactcgtcttaggacgaatcctgcagctgcaaaacacagaaaatctggccaagacctatttatctatttacaggtaagaggaggccatgctgcgcacatctgtcggcatgaaggccagtacaaccagcaagacgagcaggcagaccggcagccacagcagnnnnnnnnnnnnnnnnnnnnnnnnnnnnnnnnccagcggcagtatcagcagcgagacggtgaggcaggcgagcacgaggaatgccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttgccatgtgttctttggtgtaggcggaggtggagaccagtcgcagtgagtggttgccaaagtaagcaagaagtgaaaggcggtgtagaaccgccttgngttttctgaacgttttgtaatcagatctgagctcgggtggtcgaa

SEQ ID NO: 29 - DNA, 578 bp, Vitis vinifera
tttttttttttttttttaatcaagaaataaaataactgattttcatctgaatatcaagacaaataacaaaaattgtatgatgagaagaggtgcacttttgaacaccaccatttacacatatgtataagtcaaatctctgacattagaaggcatgaaagccaagatcataagcactgctagaatgccaatggggagcagaagcagcatgaaaggagggggtggcaatggtggtagtatcaggggaaggatcagcaatgaagccgtgagacagatgagcaaaagcaatgactccaagctgaaatagcttgctgggatcagtctcctgctgttctctcgtgagaggggagttctattatattccatcttctttccttcggccataggaggagtagggtttttcctctcaacttgcagaggagcagagttcctccttcctctcgcttccatgatgccactcaaatatcgatcttgcagattgatcaaaggtccttcagacagtcttgaatctgcttcaggctgctcaatactcatttaaatttctcctttaccggtcaccaagttccaaccggttcaaagta

SEQ ID NO: 30 - DNA, 704 bp, Citrus reticulata
  misc_feature (619)..(619): n is a, c, g, or t
agggtttcttcaaagataggtagccatttgcacatttgaatctgcttgttggatattgtcaaggaggctgttggaattaggccacatttcagaatctggtttcatcctggatcgctgggcatttgaaggcattttgtgatcatcgctgtttaaaatttggccgcatattagaatctgggttctcatcggttttccgtacatttaccttgaccacattttgatatctgggttgagctgcattttagccttcgtatttaaaaggacttgatctaatctggggtcttggtgagccggggcaactgatcatagtaaatgaattctgataattctgagtcgagacagagactatcaaagggcattataaacttgcaagatcgatatccgaccagcattatggatcgtggtgtaagaaaaattgcaactcctccggtcgagaagaggaaagttgagtatcaccgaagttactcgcaaggggcatccagaaaactgttttcggcaagctatttcaccctggaatcattgcttttgctcgtatgtctgacggcctcattgctgatcctgccattggtgcttccgcccttgccgcccccgccattcctgctgcttctggttcctatangtattctagccgtgcttttggtcttggcattcatgccttctaatgtaagagatataacttccacgtacgtgtaaatggtgttgct

SEQ ID NO: 31 - DNA, 382 bp, Lycorpersicon esculentum
gaaaaaaatgtatttaatcattatgtaaaaaacaagtgaatctactttgatattttcttctaaattaaaccacacaattaaagatatgagcaagtcacattcctaacattagaaggcataaaagctaagatcataagaacaacaagaatgaaaattgggactaacaacaacataaaaggtggtggtggcaatggtggaagcatcaatggcaaaagtaacaaagatgctgtaagaccaagtaacaaaataattgactctaagctaaaataattcattgacaacattttcttgccatgtccttgtgtaaatgatctcttatgctccatcttattgccttccataatgttgttgaaatattgttgatgttcctccaaattaataa

SEQ ID NO: 32 - DNA, 624 bp, Lycorpersicon esculentum
tttgttaaagattggcacattttcaagttcagtattcattcgatttttgatatctacataaaaaaaaagtgtcctggtactactcaatattcctcagaacgacttcatattcaggtctcgaattcaaaacctcacatcaagattcttaggaaatttcaagattggttgaaaaactcatatccttctctaagtttcaagattggttccaaattaaaactcgagacttctgagtaagagcgtacgactagtaatgaacatggacatggaatcatcagaggcaaaattgagatcatcaaaagggtttattaatttggaggaacatcaacaatatttcaacaacattatggaaggcaataagatggagcataagagatcatttacacaaggacatggcaagaaaatgttgtcaatgaattattttagcttagagtcaattattttgttacttggtcttacagcatctttgttacttttgccattgatgcttccaccattgccaccaccaccttttatgttgttgttagtcccaattttcattcttgttgttcttatgatcttagcttttatgccttctaatgttaggaatgtgacttgctcatatctttaattgtgtggtttaattta

SEQ ID NO: 33 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagcc

SEQ ID NO: 34 - protein, 77 aa, Medicago sativa
MVRCFSLGSVLILIALAASMVVLPLMLPPLPPPPLALLFFPVGIMAALVVLAFSPSENVKNVVVYSSSSSGIANSKR

SEQ ID NO: 35 - protein, 78 aa, Medicago sativa
MIMVASKEKTNSGGCMFRYSVLILSLLALSILVLPLVMPPLPPPPLLLLLVPVFIMLLLFFIAFSPSKKVPNKASFVS

SEQ ID NO: 36 - DNA, 613 bp, Hordeum vulgare
cttccgagaaagatgcttcatattgcactcatcttatgccaacacacaatcagaaacaaaaaccacgcagcaagcctatttacaagtaagaggtggccatgctccgcacatcagtcggcatgaaggccagcaccatcaacaggatgagcaagcagaccggcaagagcagcagtagcgatggcggtgggggcaacggaggcagcaccaatggcagtatgagcaatgaaacggtgaggcaggcgagcacgaagaacgcttcgacgccgaagtagttcggtatgacaaccttcttgtcagcagcatttgccctctgctgctgcatttgcctctttgcagtatttggtctggctaacacagggctgctcctctgcctactaccgcctctgtccattgcaccgaactggctatccatctattctttggtgagtgcagatcagcggctatccaggaactgagatgaataagaacttgtggaatctgaaggtttttaacagatctgaagtctttgtgagtccgtgactgaactgcagatcatctgctgtggaagaactgcaccgcaagtggcaataccttcgatcctgaaacttgcattttggtgatgcccgtaccacgc

SEQ ID NO: 37 - DNA, 617 bp, Saccharum officinarum
  misc_feature (451)..(451): n is a, c, g, or t
ggagaacgtgcttgttcaggtggttcaacagtgcggaccagagaacaatgcgaggttcaggattaaaggtattctggcttcagaggcagttcttccaaagcaagtgacaggcgattccatcaccggagctaagatcttattacaacattcagaaacacaggagtcctcccaccgcctttcacttcttgcttacttctgcaaccactcgccgtgactgatctccacgcacaccaaagaacacaacacgtggcaagccgatctagcgcgatggaaggaggggggcaaatacagaggaggaataatgccgtgaagcggcacctgcagcagcggcagcaggaggcggatttcctcgacaagaaggtcatcgcgtccacctatttcagcatcgaggcgttcctcgtgctcgcctgcctcaccgtctcgctgctgatactgccgcttgtgctgccgncgctgccggcgccggcgtcgctgctgctgtggctgccggtctggctgctcgaactgctgattgtgcttgccttcatgccgacagatgtgcgcagcatggcctcctcttacttgtaaaaaaatagataaataggccacctttggcaattttctggggtttggaggtg

SEQ ID NO: 38 - DNA, 638 bp, Saccharum officinarum
gattttttccaagccagtgaccggcgattcatcaaccggagctgagatcttatacaacattcagaaacacaggagtcctcgcaccgctttccactcttggctaattttgcaaccactcgccgtgactgatctccacgcacaccaaagaacacaacacgtggcaacccgatctagcgcgatggaaggaggggggcaaatacagaggaggaataatgccgtgaagcggcacctgcagcagcggcagcaggaggcggatttcctcgacaagaaggtcatcgcgtccacctatttcagcatcgaggcgttcctcgtgctcgcctgcctcaccgtctcgctgctgatactgccgctggtgctgccgccgctgccgccgccgccgtcgctgctgctgtggctgccggtctgcctgctcatcctgctgattgtgctggccttcatgccgacagatgtgcgcagcatggcctcctcttacttgtaataaatagataaataggccaccttggtcaatattctgtgatttggaggtgattcgtcctgagatgagtctcgattgatgtcagctactcccaaggggaaatgcatgtaacacttggtggccgacggtggcaagataatcatgctaccatgtcagttaaacc

SEQ ID NO: 39 - DNA, 778 bp, Sorghum bicolor
gctgttggtgttgttcttgagatctctttcttgatcttgtgtgggattaaagagggattcttgccttcctacgggagaaagagaaaaggggaagaacgtgcttgttccggtggttcaacagtgcggagacccggagaacaatgcgaggttcaggattaaaggtgttctggcttcaggtgcagttcttccaaagcaggtgacaggcgattcgatcaccggagctcagatctgacgaaaacaaaacacagtcctcctcccaccgcctttcagttcttgcttacttctgcaaccactcactgcgaccgtacaccaaagaacactgcacatggcaagccgatctagcgcgctggaaggagggggggcagcaatacagcggaggaataatgccgtgaagcggcacctgcagcagcggcagcaggaggcggatttccacgacaagaaggtcatcgcgtccacctacttcagcatcggcgcgttcctggtgctcgcctgcctcaccttctcgctgctcatcctgccgctggtgctgccgccgctgccgccgccgccgtcgctgctgctgtggctgccggtctgcctgctcgtcctgctggttgtgctggccttcatgccgacagatgtgcgcagcgtggcggcctcttacttgtaaatagccagataaataggccaccacctttggccagttttctgtgttttcgggggtgattcgtcctaagatgagtcatgatcgagtgtaatgtgaagcatcttttccaggggtagtagatttcaatgaagt

SEQ ID NO: 40 - DNA, 732 bp, Arabidopsis thaliana
ttgtcttcctcatttccctactagtacttgtttcacacagtttcttgatccaaccaaaaccaatacacaaagcttctcaaactccttcacctcaaagcttcttcctttacatctgaatcgttgagttaactcggatttgttctgcatcctctgtttctgaatcgtgggccatccttattttgtctcgaattcttcaccaattgcttcgatcaagctgcattggttaaccagttgccctaaagatcagatctttgagcaaaattttgtcactgatcttctaaatccaaaccagacacagcaaaacaacctctgtagatgattcgagaaatctcaaacttacaaaaagatattataaacattcaagacagttattcgaacaaccgagtcatggacgtcggaagaaacaaccggaaaaacatgagctttcgaagttcgccggagaaaagcaagcaagagttacggcggagtttctcggcgcagaaaaggatgatgatcccggcgaattatttcagtttagagtctctgttcctattggttggtctaacggcatctctgttaatacttccgttagttttgccgccgttacctccgcctccgtttatgctgctattggttcccattgggattatggttttactcgtcgttcttgccttcatgccttcttctcattctaatgctaatacagatgtaacttgcaatttcatgtaaatctgaaatttattatatgatgat

SEQ ID NO: 41 - DNA, 891 bp, Arabidopsis thaliana
cccactttatttcttcttctctggttttcttaccaaaagaaactttcttcgtcttcctctgtatttaagctttaacaccctgtttttggtttccaacgttcaatcttcatcttcttctcgctgaaggtgtgtttggctctaacggtttaaagctttcttgaaacaccaattgaatcttttctctctaccggcaaaaaaaaaagattagtccttttaggtctggaaacgccaagatcactcgttctaaaccttagattttgtctgcatttcgggataatcatttcatcgtcagggttcttcaaccaaactacatttacagaagaagaagaagaagaaaagttcgttactttttatgcgtttggataaacaaactcaagtttcttcttcatacatcgatctgattttccagatcaaacttcgaaaagagaaaaagccttctttaaatgattcgtgagttctccagtctacaaaacgacatcataaacattcaagaacattattctctcaacaacaacatggacgtgagaggagatcataaccggaaaaacacgagttttcgtggttcagctccagctccgattatggggaagcaagaattgtttcggacattgtcgtcgcagaacagtccaaggaggctaatatcagcgagttacttcagtttagaatcaatggttgtgcttgttggtctcacagcatctctcttgatcttaccgttgattcttccaccattgcctcctcctccttttatgctgcttttgattcctattgggattatggttttgcttatggttcttgctttcatgccttcttctaattccaaacatgtttcttcttcttccacttttatgtaataaacgtttctttaattgaagaaagaaatccttaaacaaa

SEQ ID NO: 42 - DNA, 732 bp, Arabidopsis thaliana; identical to SEQ ID NO: 40

SEQ ID NO: 43 - DNA, 519 bp, Zea mays
atgcgaggttcgggatttaagatgttcggctttaggggcagttcttctgaagcaggggacgggcgattcgaccaccggagctcagatctgattacaaaacgttcagaaaacacaaggcgttctcacaccgcctttcacttcttgcttactttggcaaccactcactgcgactggtctccacctccacctacaccaagaacacatggcaagccgatctacgcgatggaaggaggggcggcaatacaaaggaggaatgccgtgaagcggcatctgcagcagcgtcagcaggaggcggatttcctcgacaagaaggtcatcgcgtccacctacttcagcatcggggcgttcctcgtgctcgcctgcctcaccgtctcgctgctgatactgccgctggtgctgcctcccctgccgccgccgccgtcgctgctgttgtggctgccggtctgcctgctcgtcttgctggttgtactggccttcatgccgacagatgtgcgcagcatggcctcctcttacctgtaa

SEQ ID NO: 44 - protein, 98 aa, Zea mays
MEGGAAIQRRNAVKRHLQQRQQEADFLDKKVIASTYFSIGAFLVLACLTVSLLILPLVLPPLPPPPSLLLWLPVCLLVLLVVLAFMPTDVRSMASSYL

SEQ ID NO: 45 - DNA, 2745 bp, Arabidopsis thaliana
atgagcaatgcttttttataatgccaactttgtacaaaaaagcaggcttaaacaatgaaatctcgagcgaggcagtgtctgctggtttgtttgctctgtctttccttaacgaatctctcctatggagaaaataagttcagagagcgtaaagccaccgatgacgagctgggctaccccgatattgatgaagatgctttattgaatactcagtgcccgaaaaaattggagctgcgatggcaaactgaagtcacttctagcgtttatgctacacccttgattgctgatattaacagtgatggaaagcttgacattgttgttccatcttttgttcattacctcgaagttcttgaaggagctgatggagacaagatgccaggttggcctgcttttcaccagtcaaatgtgcactcgagtcctcttctatttgatatcgacaaagatggtgttagagaaattgctctggctacctacaatgccgaagtgctctttttcagggtatcaggctttttgatgtcagataagctagaagtgccacgtagaaaagtgcacaagaactggcatgtgggacttaatcctgatcctgttgaccgttcacatcctgatgttcatgatgatgtgcttgaggaggaagctatggcaatgaagtcatcgaccactcaaacgaatgcaactaccacaacaccaaatgttacagtctcgatgaccaaagaagttcatggcgctaattcatatgtgtcaactcaagaggatcaaaagagaccagagaataatcaaacagaagctattgtaaagcctactccagagctacataattcctccatggatgctggagcaaataatttggcagcaaatgctactacagctggctcaagagaaaacctcaatagaaatgtaaccaccaatgaggtggatcaaagcaaaattagtggagataagaatgaaactgttattaaattaaatactagtacgggtaattcctcagaaactctggggacatctggaaacagtagtacggcagagacagtaaccaaaagtgggaggcgacttctggaagaggatggttcgaaagaatctgtggacagccattcggacagtaaagacaacagtgagggtgtccgcatggcgacagtagaaaatgatggaggcttagaagctgacgcagattcatcgtttgagttgttgcgtgagaatgatgagttagctgatgaatacagttatgattatgacgattatgttgatgagaaaatgtggggtgatgaggaatgggttgaggggcagcacgagaactcagaagattatgtgaatattgacgcccatatactatgcactcctgtaattgctgacatagacaaagatggagtacaggagatgattgttgctgtttcctatttcttcgaccccgagtactatgataatccagaacatctgaaagagcttggtggtatcgacattaaaaattatattgctagttcaattgtggttttcaatcttgatactaaacaagtcaagtggatcaaagagctagatttgagtacggataaagcaaacttccgtgcttatatttattcttcaccaacggttgttgatttggatggcgatggttatttggatatccttgtcggaacttcctttggcttattctacgccatggatcatcgtggaaacatcagagaaaaattcccactggaaatggctgaaattcaaggagcagtggttgcggccgacataaatgatgatggaaagattgaacttgtaactactgattcacacggaaatatagcagcatggaccacccaaggagtggaaatttgggaagcacatcttaagagccttgttccccagggtccttctataggcgatgttgatggtgacggacacacggaggttgtggttcctacatcatcaggaaacatatacgttcttagtggcaaggatggttctattgtccgtccttacccatacaggactcatggaagagtgatgaaccaacttcttcttgttgatctgaacaagcgaggtgagaaaaagaagggtctcaccatcgttactacatcctttgacggttacctgtatctcatagatggacccacctcgtgcactgacgttgttgacattggcgaaacttcatacagcatggtcttggctgataatgttgacggtggagatgatctcgatcttattgtctcaactatgaatggaaacgtcttttgcttctcaacgccttcttctcaccatccccttaaggcttggagatctagtgatcaaggcaggaacaataaggccaatcgttatgatcgtgaaggcgtttttgtcacgcattcgaccagaggtttccgtgatgaggaaggcaaaaacttctgggctgagatcgagatcgttgataaatatagatatccatctggttcacaagcaccctacaacgttactacgacgctgttggttccaggcaattaccagggagagaggaggataacgcagagccagatctatgaccgccctggaaaataccggataaaactaccaactgtgggagtgagaacaacaggaactgtaatggtggagatggcagataagaatggactccatttctcagacgaattctcactaactttccatatgtattactacaagcttctgaaatggcttcttgttctcccgatgctcgggatgttcggtctgctcgtgatactacggcctcaagaagccgtgcctctcccgtctttttcccgcaacacagatttatga

SEQ ID NO: 46 - protein, 896 aa, Arabidopsis thaliana
MKSRARQCLLVCLLCLSLTNLSYGENKFRERKATDDELGYPDIDEDALLNTQCPKKLELRWQTEVTSSVYATPLIADINSDGKLDIVVPSFVHYLEVLEGADGDKMPGWPAFHQSNVHSSPLLFDIDKDGVREIALATYNAEVLFFRVSGFLMSDKLEVPRRKVHKNWHVGLNPDPVDRSHPDVHDDVLEEEAMAMKSSTTQTNATTTTPNVTVSMTKEVHGANSYVSTQEDQKRPENNQTEAIVKPTPELHNSSMDAGANNLAANATTAGSRENLNRNVTTNEVDQSKISGDKNETVIKLNTSTGNSSETLGTSGNSSTAETVTKSGRRLLEEDGSKESVDSHSDSKDNSEGVRMATVENDGGLEADADSSFELLRENDELADEYSYDYDDYVDEKMWGDEEWVEGQHENSEDYVNIDAHILCTPVIADIDKDGVQEMIVAVSYFFDPEYYDNPEHLKELGGIDIKNYIASSIVVFNLDTKQVKWIKELDLSTDKANFRAYIYSSPTVVDLDGDGYLDILVGTSFGLFYAMDHRGNIREKFPLEMAEIQGAVVAADINDDGKIELVTTDSHGNIAAWTTQGVEIWEAHLKSLVPQGPSIGDVDGDGHTEVVVPTSSGNIYVLSGKDGSIVRPYPYRTHGRVMNQLLLVDLNKRGEKKKGLTIVTTSFDGYLYLIDGPTSCTDVVDIGETSYSMVLADNVDGGDDLDLIVSTMNGNVFCFSTPSSHHPLKAWRSSDQGRNNKANRYDREGVFVTHSTRGFRDEEGKNFWAEIEIVDKYRYPSGSQAPYNVTTTLLVPGNYQGERRITQSQIYDRPGKYRIKLPTVGVRTTGTVMVEMADKNGLHFSDEFSLTFHMYYYKLLKWLLVLPMLGMFGLLVILRPQEAVPLPSFSRNTDL

SEQ ID NO: 47 - DNA, 53 bp, Artificial sequence
  primer: prm06643
ggggacaagtttgtacaaaaaagcaggcttaaacaatgaaatctcgagcgagg

SEQ ID NO: 48 - DNA, 52 bp, Artificial sequence
  primer: prm06644
ggggaccactttgtacaagaaagctgggtcctgtttacagatggtacctagt

SEQ ID NO: 49 - DNA, 4938 bp, Artificial sequence
  expression cassette
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatgaaatctcgagcgaggcagtgtctgctggtttgtttgctctgtctttccttaacgaatctctcctatggagaaaataagttcagagagcgtaaagccaccgatgacgagctgggctaccccgatattgatgaagatgctttattgaatactcagtgcccgaaaaaattggagctgcgatggcaaactgaagtcacttctagcgtttatgctacacccttgattgctgatattaacagtgatggaaagcttgacattgttgttccatcttttgttcattacctcgaagttcttgaaggagctgatggagacaagatgccaggttggcctgcttttcaccagtcaaatgtgcactcgagtcctcttctatttgatatcgacaaagatggtgttagagaaattgctctggctacctacaatgccgaagtgctctttttcagggtatcaggctttttgatgtcagataagctagaagtgccacgtagaaaagtgcacaagaactggcatgtgggacttaatcctgatcctgttgaccgttcacatcctgatgttcatgatgatgtgcttgaggaggaagctatggcaatgaagtcatcgaccactcaaacgaatgcaactaccacaacaccaaatgttacagtctcgatgaccaaagaagttcatggcgctaattcatatgtgtcaactcaagaggatcaaaagagaccagagaataatcaaacagaagctattgtaaagcctactccagagctacataattcctccatggatgctggagcaaataatttggcagcaaatgctactacagctggctcaagagaaaacctcaatagaaatgtaaccaccaatgaggtggatcaaagcaaaattagtggagataagaatgaaactgttattaaattaaatactagtacgggtaattcctcagaaactctggggacatctggaaacagtagtacggcagagacagtaaccaaaagtgggaggcgacttctggaagaggatggttcgaaagaatctgtggacagccattcggacagtaaagacaacagtgagggtgtccgcatggcgacagtagaaaatgatggaggcttagaagctgacgcagattcatcgtttgagttgttgcgtgagaatgatgagttagctgatgaatacagttatgattatgacgattatgttgatgagaaaatgtggggtgatgaggaatgggttgaggggcagcacgagaactcagaagattatgtgaatattgacgcccatatactatgcactcctgtaattgctgacatagacaaagatggagtacaggagatgattgttgctgtttcctatttcttcgaccccgagtactatgataatccagaacatctgaaagagcttggtggtatcgacattaaaaattatattgctagttcaattgtggttttcaatcttgatactaaacaagtcaagtggatcaaagagctagatttgagtacggataaagcaaacttccgtgcttatatttattcttcaccaacggttgttgatttggatggcgatggttatttggatatccttgtcggaacttcctttggcttattctacgccatggatcatcgtggaaacatcagagaaaaattcccactggaaatggctgaaattcaaggagcagtggttgcggccgacataaatgatgatggaaagattgaacttgtaactactgattcacacggaaatatagcagcatggaccacccaaggagtggaaatttgggaagcacatcttaagagccttgttccccagggtccttctataggcgatgttgatggtgacggacacacggaggttgtggttcctacatcatcaggaaacatatacgttcttagtggcaaggatggttctattgtccgtccttacccatacaggactcatggaagagtgatgaaccaacttcttcttgttgatctgaacaagcgaggtgagaaaaagaagggtctcaccatcgttactacatcctttgacggttacctgtatctcatagatggacccacctcgtgcactgacgttgttgacattggcgaaacttcatacagcatggtcttggctgataatgttgacggtggagatgatctcgatcttattgtctcaactatgaatggaaacgtcttttgcttctcaacgccttctcctcaccatccccttaaggcttggagatctagtgatcaaggcaggaacaataaggccaatcgttatgatcgtgaaggcgtttttgtcacgcattcgaccagaggtttccgtgatgaggaaggcaaaaacttctgggctgagatcgagatcgttgataaatatagatatccatctggttcacaagcaccctacaacgttactacgacgctgttggttccaggcaattaccagggagagaggaggataacgcagagccagatctatgaccgccctggaaaataccggataaaactaccaactgtgggagtgagaacaacaggaactgtaatggtggagatggcagataagaatggactccatttctcagacgaattctcactaactttccatatgtattactacaagcttctgaaatggcttcttgttctcccgatgctcgggatgttcggtctgctcgtgatactacggcctcaagaagccgtgcctctcccgtctttttcccgcaacacagatttatgat

SEQ ID NO: 50 - protein, 10 aa, Artificial sequence
  conserved motif 1
  VARIANT (9)..(9): Xaa is Glu or Asp
FDGYLYLIXG

SEQ ID NO: 51 - protein, 5 aa, Artificial sequence
  conserved motif 2
  UNSURE (3)..(4): Xaa can be any naturally occurring amino acid
  VARIANT (5)..(5): Xaa is Glu or Asp
DGXXX

SEQ ID NO: 52 - protein, 9 aa, Artificial sequence
  conserved motif 3
  UNSURE (2)..(2): Xaa can be any naturally occurring amino acid
  UNSURE (4)..(4): Xaa can be any naturally occurring amino acid
  UNSURE (7)..(8): Xaa can be any naturally occurring amino acid
  VARIANT (9)..(9): Xaa is Glu or Asp
DXDXDGXXX

SEQ ID NO: 53 - protein, 36 aa, Artificial sequence
  FG-GAP domain conserved sequence
GGSSVAAGDLNGDGRPDLVVGAPGADGGTDGSVYLL

SEQ ID NO: 54 - DNA, 2449 bp, Arabidopsis thaliana
attcttcatcgttctctctgctctggtaaggagattgctgctacctactgatgcaaatctgccattgatacatctgcttgcggttagggcaaagatgaggaaacgcgatttggctattttgatgctctctggatttgctatattcttcactcttcagcacgagggtgattttgcgttcaaagaagcatggtttcatttgtatgatgaatacccagtcaaatacgaagctgatcgtctcccaccacctattgtagctgatcttaatggtgatggaaagaaggaggttctcgttgctactaatgatgccaaaattcaggttctggagcctcattccaggcgtgtggatgaaggttttagtgaagcacgtgttcttgcggaaatcactcttttgcctgacaagatccgtgttgcgtcagggagacgtgctgtggccatggccacaggtgttattgataggtactataaaaatggaactccccagaagcaggttgtggtcgttgttacctcaggttggtctgtgctctgctttgatcacaacctgaaaaagctgtgggaaacgaatctgcaggaggatttcccacataatgcacaccatagagagatagcaatttcgataagcaattacacattgaagcatggtgatacgggtttggttattgttggtggacggatggagatgcagccatataatcacatggacccatttgaggaacttggcatgacagcacaaaatgctgatcaacacagaagaagtgctactgagaatcaggcctctgaagattctggagccataaacttgcgtcacttttctgtctatgcatttgctggcaagactggccttcttcgatggagtaaaaagactgatgatgttgaagctcacacctcagatgcatcacaattaattccacaacacaattacaagcttgatgtgcatgctctaaatagccgtcacccaggagagtttgagtgcagggaatttagagaatcaattcttagtgtcatgccccatcgctgggaccgacgtgaagatacattattgaagcttgctcatttcaggcgacacaagaggaaaacattgaagaagcaggctggtagtaagtctacagcttatccgtttcacaaacctgaggaacacacacccgctggaaaggacttgtcaagaaagattccaaaattgattggaaaggctgcacgctatgctggctcggcaaaacccaagaagggtatgcaatacattccgacgataactaattacacgaagctttggtgggttcctaatgttgttgtggctcatcaaaaggaaggaattgaagctattcatttgcctactggtcgaacactttgcaagctttctctacttgaaggtggacttcacgccgacataaacggagatggtgttctcgatcatgtccagactgtcggaggcaatgttggagagagaactgtagtgagcgggtcaatggaagtgttgaagccttgctgggcagtggcaacctcaggcgttcccatccgggaacagctctttaacgtctcgatctgccatcactccccttttaacttcttgcactatggaggagattactcacgacacttcgcccaggcaagagacacctctactctggagatcgcaactcccattctcatccccagagatgatggacacaaacaccgcaaaggcagtcacggagatgtaatcttcttgacaaaccgtggagaggtgacatcatacacgcctgatgtgcacggccacgacgcagtctggcaatggcagcttcagacagaagccacatggtcgaatctcccgtctccatcgggtttaactgaatcagggacggtggtcccaaccctgaaaccattctcgttgcgcattcatgataaccagcctatgatccttgccgggggagatcaagcagcggtcatcatctctccgggaggaagcatattggcttccatcgaattaccgtctcaaccgactcatgcacttatcactgatgacttctcgaacgatggtctaacggatgtgattgtgatgacctcaaatggggtttacgggtttgttcaaaccagacagccaggggctctgttcttcagttcgttggtgggttgtctcttagtagttatggcagttattttcgttactcagcacttaaactccattcaaggtaagcctcgaccatcatctagcttttaatagaaatctcgtagagttttcttcctctctacggaagttaaaccggcaggtccgctttagcagcttcacccacatcggttttggtaaaccggaaatattactgatataccagtgtagattcagtgccttatttcctggtttcagctgtataactttatactttgtagaattcaagtaaaaaatggtagaggcaaatagaggactttatgtttttgtcaattttgatgttttaatggaattatgtgacatttaatttat

SEQ ID NO: 55 - protein, 698 aa, Arabidopsis thaliana
MRKRDLAILMLSGFAIFFTLQHEGDFAFKEAWFHLYDEYPVKYEADRLPPPIVADLNGDGKKEVLVATNDAKIQVLEPHSRRVDEGFSEARVLAEITLLPDKIRVASGRRAVAMATGVIDRYYKNGTPQKQVVVVVTSGWSVLCFDHNLKKLWETNLQEDFPHNAHHREIAISISNYTLKHGDTGLVIVGGRMEMQPYNHMDPFEELGMTAQNADQHRRSATENQASEDSGAINLRHFSVYAFAGKTGLLRWSKKTDDVEAHTSDASQLIPQHNYKLDVHALNSRHPGEFECREFRESILSVMPHRWDRREDTLLKLAHFRRHKRKTLKKQAGSKSTAYPFHKPEEHTPAGKDLSRKIPKLIGKAARYAGSAKPKKGMQYIPTITNYTKLWWVPNVVVAHQKEGIEAIHLPTGRTLCKLSLLEGGLHADINGDGVLDHVQTVGGNVGERTVVSGSMEVLKPCWAVATSGVPIREQLFNVSICHHSPFNFLHYGGDYSRHFAQARDTSTLEIATPILIPRDDGHKHRKGSHGDVIFLTNRGEVTSYTPDVHGHDAVWQWQLQTEATWSNLPSPSGLTESGTVVPTLKPFSLRIHDNQPMILAGGDQAAVIISPGGSILASIELPSQPTHALITDDFSNDGLTDVIVMTSNGVYGFVQTRQPGALFFSSLVGCLLVVMAVIFVTQHLNSIQGKPRPSSSF

SEQ ID NO: 56 - DNA, 2834 bp, Oryza sativa
atgcgtcccctcctcgccttcgcggcggtatgcgcccttctcgtggctgccgcagcgccggcggccgcggaggaggagaaggcgaacaagttccggcagcgcgaggccaccgacgacatgcttggatacccccaccttgatgaagatgctttattgaagaccaagtgtccaaaacatgtagagctgagatggcagactgaagttagttccagcatttatgcaactccgttgatcgctgatatcaacagcgatggaaagttggaagtagtggtgccatcatttgttcattacctggaagttcttgaaggctctgatggggacaaattgccaggatggcctgcatttcaccagtcaaatgttcattcaagtccacttctatatgatattgacaaggacgggacacgggaaatagttttggcaacttacaatggtgtagtgaatttcttcagggtatcaggttatatgatgatggacaagctagaagtacctcgtaggaaggtacacaaagactggtatgttgggctgaatacagatcccgttgaccgctcccatccagatgttcatgacagctcaattgcaaagaaagctgcttctgaagaatctcacccaaatattcaggacaagccagttgtgaatgaatcttctaaggaatcccagtcacggagcacaaatgactcaacaacacgaggagttgattccatgaaacatgcgtctaaggaagagccagttgaaagtaaacctaattctacccgaggacaggagaatatggatgtgttaaacaatctaaacagcacagatgctgggaacaactctagtttaagtactacaacagagaatgcatcacatgttcagagaaggttgcttcaaacagatgagaaaagtaatcaagcaggaagctcagaaactgatgcaagtgataccggaacagcaaaagcagctactgttgaaaatagcgagcctctagaggctgatgctgatgcatcatttaatttgtttcgggatgtagaagatctgcctgatgagtacaattacgattatgatgactacgttgatgaaaccatgtggggagacgaggactggaaagaacaacaacatgaaaaggcagaagattatgtgagcatagatgctcacatcttgtccaccccagtgattgcagatattgacagagatggcatacaagaaatggtgatttctgtatcttacttctttgaccacgagtattatgataaaccagaacatctaaaggagttaggagggattgacattggcaaatatattgcaagcagtatagttgtttttaaccttgacacaagacaagtcaaatggactgcagaacttgatttgagtacagatagtggaaattttactgcccatgcatattcttcgccgaccgtggttgatttggatggtgatggaaatttggatattcttgttggaacttcctttggcttgttttatgttatcgatcatcgtggtaaggttaggaacaagttcccacttgagatggcggagattcatgcaccagtcattgcagcagatatcaatgatgatgggaaaatcgagatggtcactgctgatgtccatggcaatgtagcagcatggactgcagagggagaagaaatctgggaggttcatcttaagagtcttatcccacagcgccctactgttggtgatgttaatggagatggtcgcactgaagttgtggtcccaaccgtgtcaggaaacatatatgttcttagtggaaaggatggctcaaaaattcagcctttcccatatagaacgcatggaaggatcatgagtcctgttctattgcttgacatgagcaaacatgatgaaaagtctaaaggcctcacccttgctactacatcctttgatggttacttgtatttgattgagggctcaagtggctgtgcagatgttgttgacattggagagacctcgtacagtatggttttggctgataatgttgatggtggagatgacctcgatcttattgttactaccatgaatggcaatgtcttctgcttctccactccctctccgcaccatccacttaaggaatggagatcatcaaaccagggaagaaacaatgctgcatatcgttacaaccgtgaaggtatttatgttaaacacggttccagaacattccgtgacgaagagggcaagcatttctgggtagagtttgagattgtggacaagtacagggttccttatgggaaccaagctccttataacgtgacggttactctacttgtccctgggaattatcaaggagaaaggcgcattgtggttaatgcagcttataatgaaccaggcaagcagcggatgaagcttcccacagttcctgtgagaaccacaggaactgtgcttgtggaaatggttgacaaaaacgggttctacttctctgacgagttctcgctcaccttccacatgcattattacaagcttctgaaatggctcgtgcttcttccaatgcttgggatgtttagcgttcttgtcatcctgcggccacaagaaggcgctccgttgccatcattttcaaggaatattgattagtgatttgcacagtgaaacgtcaggtcctcatagaagcagataagcagaacaagatattagcaggatatccaatcacccatgaaggagcttgtccacatcatactgcatcggggagctcaatctgcacagaaaaaacccctcacgatgctgcatcccatcagttagctagttcgggaagtacagcttttagtcatgcaaaaagaattttgtcacacttgagattgttttctaacttatgatatttacacaaggaactggcagctgtctgatcctggttt

SEQ ID NO: 57 - protein, 851 aa, Oryza sativa
MRPLLAFAAVCALLVAAAAPAAAEEEKANKFRQREATDDMLGYPHLDEDALLKTKCPKHVELRWQTEVSSSIYATPLIADINSDGKLEVVVPSFVHYLEVLEGSDGDKLPGWPAFHQSNVHSSPLLYDIDKDGTREIVLATYNGVVNFFRVSGYMMMDKLEVPRRKVHKDWYVGLNTDPVDRSHPDVHDSSIAKKAASEESHPNIQDKPVVNESSKESQSRSTNDSTTRGVDSMKHASKEEPVESKPNSTRGQENMDVLNNLNSTDAGNNSSLSTTTENASHVQRRLLQTDEKSNQAGSSETDASDTGTAKAATVENSEPLEADADASFNLFRDVEDLPDEYNYDYDDYVDETMWGDEDWKEQQHEKAEDYVSIDAHILSTPVIADIDRDGIQEMVISVSYFFDHEYYDKPEHLKELGGIDIGKYIASSIVVFNLDTRQVKWTAELDLSTDSGNFTAHAYSSPTVVDLDGDGNLDILVGTSFGLFYVIDHRGKVRNKFPLEMAEIHAPVIAADINDDGKIEMVTADVHGNVAAWTAEGEEIWEVHLKSLIPQRPTVGDVNGDGRTEVVVPTVSGNIYVLSGKDGSKIQPFPYRTHGRIMSPVLLLDMSKHDEKSKGLTLATTSFDGYLYLIEGSSGCADVVDIGETSYSMVLADNVDGGDDLDLIVTTMNGNVFCFSTPSPHHPLKEWRSSNQGRNNAAYRYNREGIYVKHGSRTFRDEEGKHFWVEFEIVDKYRVPYGNQAPYNVTVTLLVPGNYQGERRIVVNAAYNEPGKQRMKLPTVPVRTTGTVLVEMVDKNGFYFSDEFSLTFHMHYYKLLKWLVLLPMLGMFSVLVILRPQEGAPLPSFSRNID

SEQ ID NO: 58 - DNA, 2411 bp, Oryza sativa
gagtgtctaggccagtccagtccagtccagtccaggacggtccagtccggtcccgtagagcgccggcgcgtgtagcttcctcctccgctccaggctccagcgagggagggagggagaccaccgtctccgccggctttgagagagaaagagaaagagagagagagagagcggcgagatgcggaagcgggatctgggcatcctcctcctcgccgccttcgccgtcttcttctcgctccagcacgacggcgacctctccttccgcgaggcctggtaccacctctccgatgccgactaccccatcaagcacgacgccgaccgcctcccctctcccctagtcgccgacctcaacggcgacggcaaacccgaggtcctcatccccacccacgacgccaagatccaggtcctccagccccaccccaggccctcccccgacgatgcctccttccacgacgcccgcctcatggctgatgtctccctcctcccctccaacgttcgcctctcctccgggaggcgccccgtcgccatggccgttggcaccgtcgaccgccactacgcccacgccccctccccctccaagcagctcctcgtcgtcgtcacctccggatggtccgtcatgtgcttcgaccacaacctcaaaaagctctgggaggctaatctccaggacgatttcccccacgccgcccaccatcgcgaggttgccatttccattaccaactacactctcaagcatggggatgcaggtttggtcatcgtcggaggaaggatggaaatgcaacatcattcagcagagcttttcgatgaatttatggtgtcagaacacaacagggaagagcaccgtagaagcgccagtgagaagcaggcttctgagacaggcaacacagacctgcgtcattttgccctttatgcttttgctggccgcactggtgaattaagatggagccgaaagaatgagaatatcccatcgcaaccatccgatgcttcagtgctgataccacaacacaattacaagcttgatgcccatgcccttaatagtcgtcatcctggtcagttcgaatgtcgggaatttagagaatcagttcttggggtcatgcctcatcattgggataggagagaggatacttttctgcaacttgcccattttaggaggcataaaaggaaagcactgaagaaaacacctggaaaagctgttgtaaataacgtgcacaagcccagtgaacataatccacctggaaaggatgtttccaataggttagcaaatgtgattgggaaagctgcagatatggctaattcaaataaaatcaagaagtcacaaaggacgctttatgttccgacaatcaccaactatactcaagtttggtgggttcctaatgttgttgttgcccacgaaaaagaagggatagaggctgttcatctagcttctggacgtacaatctgcaagcttcatttaacagaaggaggccttcatgcagatattaatggagatggggttctagaccatgttcaggttgttggtgcaaatggcatcgagcaaacagttgttagtggttcaatggaagtgctgaaaccttgttgggcagtagctacatctggtgtgccagtgcgggagcaactttttaatgtttctatctgccattacaacaatttcaatttgtttcatcatggtgacttttcaagaagttttgggaggacatttgatacaactggcttagaggtggcgactcctattctgctccagagagatgatggtcataaacacaggagaggaagccacggggatatcatctttcttacgagtcgtggggaggtgacctcgtactctccaggtctacttggtcatgatgcaatatggagatggcaactgtcaacaggtgcaacatggtccaaccttccgtctccatcagggatgatggaaaacattgtagttccaactttgaaggctttctctctgcgagcctatgacccaaaacaggtaatcatcgcgggtggtgatctggaggctgtggtgatttctccttctggtggtttattggcatccattgaactccctgcacctccaacccatgcgctggtacttgaagatttcaatggtgatggtttaactgatattattctggtaacatcggggggagtctatgggtttgtgcagacaagacatcctggggctcttttcttcagcacgcttgtgggttgcttgatagttgttatcggagtgatatttgtttcactgcacctcaactcctcgaacagcggtaaacctagggcttcaaccgactataggtgacgacattatgtcagtcgacagaattccttgtcaatattgaggtgttgttatagcatttgatttagatttttcatataatcaactgccaactgggttatgtaaacttgtgcggcgaatgcatttttggcgt

SEQ ID NO: 59 - protein, 701 aa, Oryza sativa
MRKRDLGILLLAAFAVFFSLQHDGDLSFREAWYHLSDADYPIKHDADRLPSPLVADLNGDGKPEVLIPTHDAKIQVLQPHPRPSPDDASFHDARLMADVSLLPSNVRLSSGRRPVAMAVGTVDRHYAHAPSPSKQLLVVVTSGWSVMCFDHNLKKLWEANLQDDFPHAAHHREVAISITNYTLKHGDAGLVIVGGRMEMQHHSAELFDEFMVSEHNREEHRRSASEKQASETGNTDLRHFALYAFAGRTGELRWSRKNENIPSQPSDASVLIPQHNYKLDAHALNSRHPGQFECREFRESVLGVMPHHWDRREDTFLQLAHFRRHKRKALKKTPGKAVVNNVHKPSEHNPPGKDVSNRLANVIGKAADMANSNKIKKSQRTLYVPTITNYTQVWWVPNVVVAHEKEGIEAVHLASGRTICKLHLTEGGLHADINGDGVLDHVQVVGANGIEQTVVSGSMEVLKPCWAVATSGVPVREQLFNVSICHYNNFNLFHHGDFSRSFGRTFDTTGLEVATPILLQRDDGHKHRRGSHGDIIFLTSRGEVTSYSPGLLGHDAIWRWQLSTGATWSNLPSPSGMMENIVVPTLKAFSLRAYDPKQVIIAGGDLEAVVISPSGGLLASIELPAPPTHALVLEDFNGDGLTDIILVTSGGVYGFVQTRHPGALFFSTLVGCLIVVIGVIFVSLHLNSSNSGKPRASTDYR

SEQ ID NO: 60 - DNA, 1103 bp, Triticum aestivum
  misc_feature (16)..(16): n is a, c, g, or t
gcgttccggagctttnaaaagagtcaggagggattgacataggaccatatattgcatgcagtatagttgtgggtaaccttgacacaaaacaagttaaatggacagcagaactcgatttgagtaccgaaagcgggaaattccttgcccatgcatattcgtctccaactgtggttgatttggatggtgatggaaatttggatatccttgtcggaacttcctatggcttgttttatgttcttgatcatcacggtaagactaggaaaaatttcccccttgagatggctgagatccatgcaccagtcattgcagcagacatcaatgatgatggtaagatcgagatggtcactgctgatgtgcatggtaatgtagcagcttggactgcagagggagacgaaatctgggaggtgcatctgaagagccttgttccacagcgacctactgtcggggacgtcaatggagatggccacactgatgttgtggtcccaactgtatcaggaaacatctacgttcttagtggaaaggatggctcaaaagttcagcctttcccatatagaacacatggaaggatcatgagtccggtcttgttagttgacatgagcaaacgtggagaaaagacgcaaggactaacccttgctactacgtcctttgatggttatttgtatttgatcgagggctctagtggctgtgcagatgttgtcgacattggagagacctcgtacactatgggtttggctgacaatgtggatggcggagatgaccttgatctgattgttactaccatgattggcaatgtcttttgctttttcactccctcaccggaacatcctctcaaggaatggagatcatcaaaccaggaaaggaataatgctgcatataggcaccacccgtcaaggtatttatgtaaggcatggttcaggacaacccgggaatgaaaagggtaaacatttcggggtcgatttgaaaattggagacaagtacagggttccctatgggaattaactccttaaaatgtcagggtaccttactcgtcctgggaattaccagggaaacaggggtattggggtttgccaattttaaaatgaaccgggcacaaggaattgggt

SEQ ID NO: 61 - DNA, 1152 bp, Zea mays
  misc_feature (232)..(256): n is a, c, g, or t
  misc_feature (416)..(474): n is a, c, g, or t
  misc_feature (525)..(529): n is a, c, g, or t
  misc_feature (1025)..(1047): n is a, c, g, or t
acaggcttattataggtttgttttctactaatagttatgaagagcgttttgacacagtatccgagagttttgcttctcctctccgagggtcgcttctcttagaatctgacaattaccgtttcaaaggcctactgtaaactctcaatggtgacaatatgcttgttctttgggtgagccaatattgaaaatggctgtgtacaaaattgttctgcagaactaaatgggtacattnnnnnnnnnnnnnnnnnnnnnnnnnaaatggttaactgttgggatactacactgaacaagacatttaggtcatggagatgttggggagtcacttcgtcagcttcaatgggtcaccggcatttcaccactagtcgatattccgtgaaaacgatggcagcggcgcaccttcttggggcctcaagatnnnnnnnnnnnnnnnnnnnnnnnnnnnnnnnnnnnnnnnnnnnnnnnnnnnnnnnnnnnagtaatgcatgtggaaggtgagtgagaactcgtcggagaagtacagcccannnnnatcgatcatctccacgaccacagttccagtagttctaacaggaacagtgggaagcatcatccgttgcttccctggttgatgatacacaccactgacaacaatgcgcctatctccttgataattccccggaacaagtaaagttaccgtcacgttataaggagcttgcttcccatagggcaccctgtacttgtcaacgatttcaaactctatccagaaattcttgccctcttcgtcacggaaggtcctggaaccatgcttaacatagataccttcacggttgtactgatatgcagcattattccttccttggtttgatgacctccattccttaagcggatggtgtggtgattgagtggagaagcagaagacgttgccattcatagtggtaacaataagatcaaggtcatctccaccatccacgttatcagccaaaaccatagtgtacgaggtctctccaatgtcaacaacatctgcacagccactcgatccctcaatnnnnnnnnnnnnnnnnnnnnnnnacgttgttgcaagagttagcccttttgcattgtctccatgtttgctcatgtcgagaagtagaacaggactcatgattcttccatgtgttctatatgggaaaggtt

SEQ ID NO: 62 - DNA, 720 bp, Solanum tuberosum
gtttcaatctagataccaagcaagttaaatggactgcacagttggacttaagtactgacgacgggaaattccgtgcctatatatactcttctcctacggtagttgatttggatggtgatggaaacatggacattctagtggggacctcctatggcttcttttatgtgttggatcacaacggcaaagtgagggaaaagttccctctcgaaatggctgaaatccaaggagcagtagttgcagctgatatcaatgatgatggaaagattgaactagttacaacagattcacatggaaatgttgctgcttggaccgcacaaggcacagaaatttgggaaacgcatctcaagagccttgttcctcagggaccggttattggcgatgtggatggagatggccatacagatgtcgttgtcccaacactttctgggaatatatatgttctgaatggcaaggacggctcatttgtacgtccatatccttataggactcatggtagggtgatgaatcgagcacttcttgtcgacttgagcaaacgtggggagaagaaaaaagggcttacaattgtcacaatgtcatttgatggttatttgtatctcatagatggaccaacatcatgtgctgatgttgtagatattggtgaaacttcatacagcatggtcttggctgataatgttgatggtggcgatgatcttgatcttattgtaacaaccatgaatggta

SEQ ID NO: 63 - DNA, 904 bp, Aquilegia
gtgaatattgattcacacatcctttgcactcctgtgattgcagacatcgacaatgacggagtatcagaaatggttgtcgctgtatcctatttctttgatcatgagtattatgacaacccagagcatctctctgagttgggtggcatagatattgggaaatatgtagcgggaggaattgtagtatttgatcttgatacaagacaagttaagtggacaacagagctagatcttagtacagacacaggggacttccgtgcttatatatattcttctccaacggtggtcgatttggatggagatggaaatttggacattcttgttgggacatcttttggcttgttttatgttttggaccataatggcaagataagaaacaagttccctctcgaaatggctgagattcagggctctgtcattgcggcggatataaatgatgatggaaaaattgaattggttacaactgatactcatggaaatgttgctgcatggaccccagaaggagaagaaatttgggaagtacatcttaagagtcttgttccacaacgtccaacagttggtgatgttgatggcgatggtcatactgatgtggtggttcctacactatcagggaacatatacgttctcagtggcaaggatggctcttttgttcacccatacccatatcgtactcatgggagagtcatgaatcaagttcttttagtagatctaagtaaacgtgaagagaaacagaagggactcactcttgtcacaacatcatttgatggctatttgtaccttattgacggaccatcatcttgtgctgatgttgttgatattggcgagacttcatatagtatggtcttggcagacaatgttgatggtggggatgatcttgatctaattgttacaactatgaatgggaatg

SEQ ID NO: 64 - DNA, 708 bp, Brassica napus
atttgggaagtgcatctaaagagtcttgttccccagggtccttcaataggcgatgttgatggtgatggacatactgatgtcgtggttcctacaacgtcaggaaacatttatgttcttagtggcaaggatggttcgattatacgtccgtacccgtacagaactcatggaagagtgatgaaccaacttcttcttgttgatctgaacaagcgaggtgagaaaaagaaggggctcaccattgttaccacatcctttgacggttacatgtacctcatagatggacccacctcatgcacggacgctgttgatattggtgaaacttcatacagcatggtcttggctgataatgttgacggtggagatgatcttgatctaatcgtctcaactatgaatggaaacgtcttttgcttctctacaccttctcctcaccatcccctcaaggcgtggagatcgactgatcaagggaggaacaataaggcaatccgttacggtcgtgaaggtgtctttgtcactcattcaaccagaggcttccgtgacgaggaaggcaaaaacttctgggctgagatcgagattgttgataactacagatacccatctggttcacaagcaccctacaacgttactacgacgttgttggtaccaggcaactaccaaggagataggaggataacacatagccagatctatgaccgaccaggaaaatacagaatt

SEQ ID NO: 65 - DNA, 834 bp, Citrus sinensis
gttgatggggatggccatactgatgttgtagttccaacactatcggggaacatttacgttcttagtggcaaggatggcagtaaagtccgtccttatccttatagaactcatggaagggtgatgaatcaagtccttcttgttgatttaactaaacgcggggagaaaagcaagggactcacaattgttacaacatcttttgatggctatttgtaccttatagatggcccaacatcatgtgctgatgtagtcgacattggcgaaacttcatatagcatggtcttagctgacaatgttgacggtggagatgatcttgatcttattgttaccacaatgaacggcaatgttttttgcttctcaactcctgctccacaccatcccctcaaggcatggagatcaattaaccaaggaagaaacaatgttgcaatccgttacaaccgtgaaggaatctatgttacacatccatcaagagctttccgtgatgaggaaggcagaaacttctgggtggagattgagattgtagatgaatatagattcccatctgggtcccaagctccatataatgtcactacaacattgttggtccccggcaattaccaaggtgagaggaggattaagcaaagccaaatctttgcacgtcgtggaaaatatagaatcaaattgccgacagtcggggtaaggacgacagggactgttttggtggagatggttgacaagaacggactttatttctcagacgaattctcgcttacattccatatgtattactataaactactaaagtggctcctagtcctcccgatgctcgggatgtttggtgtgcttgtcatccttcgt

SEQ ID NO: 66 - DNA, 906 bp, Asparagus officinalis
gggtggaaaggatggatcgtttgttcgacccttcccctataggacacgagggagattgatgagtccagttcttctggctgatttaagcaaacgtgatgaaaagttaaagggcctaactcttgttacaactgcatttgatggctatttgtacctaattgatgggtccactggttgtacggatgttgttgacattggcgagacatcatacaccatggtcttggcagataatgttgatggtggggacgatcttgaccttattgttactactatgaatggcaatgtcttttgcttttccacaccctcaccgcatcatcctctgaaggaatggagatcatccaaccagggaagaaacaatgcagcaagtagatataaccgtgaaggaatatacatatcacatggatccagagctttccgcgatgaggaaggtaaacatttctgggtggagctggagataatagacaagtacaggtttccctcagggcatcaagggccttataatgtcacaacaacattattagttcctggaaattaccaaggagaaaggcgaattgtcgtcaacaatgtatataatcaacctggaaagcaacggataaagctgccaacagttcctgttcgaacaacagggactgtgctggtggagatggttgacaagaatggattgtatttctctgatgaattttctcttacatttcacatgcattactacaagctactgaagtggcttctgtttctaccgatgctcggaatgtttggagttcttgtcattctacgtccccaggaaggtgcaccgttaccatcgttttcacgaaatttggattgatattaatgatatcatccaatgaagatgagaatactccaaagtgcgatgctatctgacatgtatgcctttgtacatctgaatgtgtg

SEQ ID NO: 67 - DNA, 779 bp, Populus
  misc_feature (34)..(39): n is a, c, g, or t
  misc_feature (663)..(663): n is a, c, g, or t
  misc_feature (686)..(688): n is a, c, g, or t
  misc_feature (739)..(744): n is a, c, g, or t
  misc_feature (746)..(748): n is a, c, g, or t
  misc_feature (760)..(761): n is a, c, g, or t
  misc_feature (766)..(769): n is a, c, g, or t
  misc_feature (773)..(777): n is a, c, g, or t
tgaatcaagttcttcttcttgacttaagtaaacnnnnnngagaaaaacaagggactcacacttgttacaacatcattcgatggttatctttaccttatagatggaccaacttcttgtgctgatgttgttgatattggtgaaacttcatatagcatggtcttggcagacaatgttgatggtggagatgatcttgatctcatagtttcaacaatgaatggaaatgtcttttgcttttcaactcctgttccacatcatcccctgaaggcttggagatctaataatcaaggaagaaacaatgtagcaaaccgctacaaccgtgaaggggtgtatattaaaccttcatcaagaagtttccgtgatgaggaggggaagagcttctgggtggaatttgagattgtggacaagtatagaatcccgtctgggtctcaagcaccttataatgtcactacaaccctgttagttcctggcaattatcaaggtgaacgacggataaagcaaaatcaaatctttgaccgtccaggaaaatatcggataaaacttccaacagttggagtgagaactactggaactgttttggtggagatggttgataagaatggactctatttctcagatgacttctcgcttacattccacatgcattactataaactgctgaagtgnctccttgtcctcccaatgcttgnnntgtttggtgtgcttgtcatccttcgtccacaagaggccgtgcccttgccannnnnntnnnggaatactgacnngtgannnncatnnnnnac

SEQ ID NO: 68 - DNA, 723 bp, Populus
ggcacgagcacacttgttacaacatcatttgatggttatttgtaccttatagacggaccaacttcttgtgctgatgttgttgatattggtgaaacttcatacagcatggtcttggcagataatgttgatggtggagatgatctagatctcatagtctcaacaatgaatgggaatgtcttttgcttttcaactcctgttccacatcaccctctcaaggcttggagatcttctaatcaaggaagaaacaacgtggtgaaccgctacaaccgtgaaggggtttatgttacaccttcatcaagaagttttcgtgatgaggagggaaagagcttctgggtggaatttgagattgtagacaagtatagattcccatctgggtctcaagcaccttataatgtcactacaacccttttagttcctggcaattatcaaggtgagagacgaataaagcaaagccaaatctttgaccgtccaggaaattatcgggtaaaacttccaacagttggagtgaggactactggaactgttttggtggagatggttgataagaacgggctctatttctcagatgacttctcccttacgtttcacatgcattactataaactgctgaagtggctcctagtcctcccaatgcttggaatgttttgtgtgcttgtcatccttcgtccacagaggccatgccccttacatcattttcaggaatactgacttgtgatatcatct

SEQ ID NO: 69 - DNA, 704 bp, Euphorbia esula
  misc_feature (10)..(11): n is a, c, g, or t
ctgatacccnntgaaatgttgctgcttggacttcacaaggaaaggaaatttgggagaggcatctcaaaagtcttatttcccagggcccatcagttggtgatgtggatggggatggccataccgatgtggtagtccctactatatctgggaatatatatgttttgagcggcaaggatgggtcaaatgttcgcccatacccatatagaacccatgggagagtaatgaatcaagttctccttgttgatttaagtaaacgtggggagaaaagcaccggactcagccttgtaacaacttcatttgatggatacttgtaccttatagatgggcccacatcctgcgctgatgtcgttgatattggtgaaacctcatatagcatggtcttagcggacaatgtagacggaggagatgaccttgacctagtagtcacaacaatgaatgggaacgtcttttgcttcgcgactcctgttccacatcatccccttaaggcatggagatcggctaatcaaggtagaaataatgtggcaaacagatttaaccgtgaaggggtctatgttacaccttcatcaagagcttttcgagacgaggaaggaaagaatttctgggtggaaatcgaaatcgtggataaatatagatacccttctggttctcaagcaccttataaagtcactacaaccctgttagttccgggtaattatcaaggtgag

SEQ ID NO: 70 - DNA, 1088 bp, Ceratopteris richardii
ccacgcgtccgggttacaacagatgcccggggaaatgttgctgcatggacaaataaaggaaaagaaatttgggaagttcacttaaaaagcttgattgctcagggtccgactgtcggagatattgatggagacggaacattggatattgttgtgccaactgtgtcaggaaatatatatgttttgcatggaaagactggtgttactatgaagccatatccatttcgtacccatgggcgtgtgatggctcctgttcttctggtggacttggccaagctaggcaccgagagaagaggtctggtcctggtggtttcatcatttgatgggtacctctacctcatagatggtcccacagcctgtgctgatgtggttgatgtaggagagacatcctacacaatggtgcttgcagacaacgttgatggaggagatgatttggatttaatagtgacgaccatgaatgggaatgttttctgcttctctacacctgctccttatcatcctttacggtcatggacctcacagaatcagggtaggagcaatcttgcatctcgtataagacatgaagggatttatgctacatctggctcgagaagtttcagggatgaaggtggtgaaagtttttgggtgcatttcaatattattgatgagaaccgcttaccttcggggccttacaatattacggctacccttcttgtcccccacaactacatgggtccaaggcgcattacagagagtcagttaattcaacaaccaggaacgcacaagttcaaactgccatgtgtatctgtacgatcatctgggactgtagttctagagatggtggataaacatgggttctatttcactgatgagtattcattgacattccacatgcactattatcggctactgaaatggatggtagtgcttccaatgcttggaatgctttttgtcttgttgtggcttcatcctgaggatgccatatcagttcttccttccttttcaagggatcattaaaatgacatatgagctcaatttttggtactcctaaatccaaaccttattgtaaatgtatacattttgacatttatccagtctactaaagaaatgca

SEQ ID NO: 71 - DNA, 830 bp, Welwitschia mirabilis
atgacaatcatgaacacttgaaggagctgggtgatattgatattagcaaatatgtttcaggtgctatagtggtatttaatcttgatacaaagcaagtgaagtggagtactcagttggatcttagcacaacctctgggacttttaatgcatacatctattcttctcctactgtggttgacctggatggtgacggcaatttggatattattgttggcacgtcatttggtttcttttatgtattggatcaccatggaaaaaatagagaaggctttccattacagatgggtgagattcaaggacaagtaattgctgctgatataaatgatgatgggaagattgaaatggttacaacagatacccgtggaaatgtggctgcttggacttctcaggggaaagaaatatgggagatacatttaaaaagtcttattgctcaggggcctacagtaggtgatattgatggagatggtcatacagatttggtggttcctacagtatcaggaaatatttatgtattaaatgggaaagatggatcattggtgaagccatttccttatcgtactcatggaagagtcatgagtccggtacttttggttgaccttagcaaacgtggggaaaagcaaaagggcttaactcttgcagcattatcatttgatggttacttctacttaattgatggtcaaacagcttgtgcagatgttgttgatattggagagacttcctactctatggctttggcggacaatgtagatggcggcgatgatcttgattttattatcacaactatgaatggcaatgtgttctgcttttcaacccctgctccacatcatcca

SEQ ID NO: 72 - DNA, 8730 bp, Medicago sativa
atgaggaagcgtgatttggcgattcttatgctctgcgctttcgctattttcttctctcttcaggtattgtaccctttaaccccctaattcactttctcactcttaaaccctaaccctcattttcaattcaattgattcagcaagatggtggtgtttcattcaaagacgcgtggatgcatctaacagatgaatacccaatcaaatacgaagccgaacgccttcctcctcctgttgtcgccgatctcaacggcgatggtaagaaagaagttctcgtagctacccacgatgccaaaattcaggttctttcatttcccaattttcctcaattttttattcacttataaaattccaggttttatttggtttccttcacaactggacattgtcaaaaaaacattttttttctttcagtaaaccatcaatgtagttgatgaactataactctcttcaatttagtttgtaagtagtctctaaaattcatcaattaatccctgctattaatgtttggttctacaccgaagaaagttgactttgaatgagttgattgtgtaaactctatttgggctaaaattgatttgaaggtaaagtgatttatgtttggactttggatacattcatgtaaaagtgaattgaacaggtgaaaaatcaactctagaatcagaagctacaatttctaactttaagtagaatgtagaatcaattctggaggtaaaatcaattttactctagaagaaccaaatatgtcaatcaattttgggtcctccaaaattagaaccaaacatacagaaagtagagactaaaattgatggattttcatatactttagggacttaattgaccggttttatatactttaaagactacttatcatatttatatagtttagggactagattgatggtacaagtaatatagtagtaactggattttgtatttatggtcggtgtcttagattttggagccacatagtaggcgtgttgatgaaggattcagtgaggcacgtgtgttagcggaggtgtctctgttgcctgacaaagtgcgtgtcatgtctgggagacgacctgttgctatggccactggctttattgaccgccatagaattggacaaccacataagcaggttttggttgtagtaacatcgggttggtttgtaatgtgttttgattccaacctccaaaagttgtgggaaaataatttgcaggtatgatgtttatgttgtgccatgtttcagttgatagaattttcagttaaacattttgattatcttgttatgttttagtttaccaactgttttagtggttgttaacaggaggatttcccccataatgctcaccacagggaagtttcaatatctataagcaattatactctcaagcatggagatacaggattgatcattgttggtgggagaatggaaatgcagcctcatgtatgtgtcactttccttcttgttttctggtttgttattctttttagcagagtatgtgtgtctgtgttctatctgctgatggaaaaacttagaatttaatgtggatggtgtttaccatcttttatgaaagcgaaaactctcaacttcatgagtagcataagattctggctatcttgttttcttggaagtgatgaaaatgaaagttcctgagtaattttatttgataaagtatgatggtaatgtgagggtttgctgctgcttctcgagtttcagaattttttatttgttatttgattctttctatggtaatgattttggaattgttcatctttggaattattggcattatcttctaatctgatggttctgttggcttatgttgattgctttccattttcagatttttatggacccttttgaagaaatgggaatgggagctagatttgctgagcagcatcgaagaagtgctactgaaaaggaggtatagatacgtttctagttgatgctaaattttatgcccatttttttactatctgtagcatgctaattttggtttaaactttgagacactatttgctttatttatttcactttaattttgggtcttcaaggttgaccttattttatgctcctaaacagtcaattcaaattcctattttgatataaatagataatataaaagttcaccatgtcttggcatgataaagccaataaataaaatctgtgcaccttgcagtaagtagtctataaatctgaaccttcatgatcaggtagctaaataaacaggagacagtttcactcgttttgtttagatttttgtttttacaaaaaaatgtatcaggtgattttagttttcttcccattttaaggttgaagactttaacttgtttattgtgttcctttttctggataggcttctgaaaacaccggaactgtggatttacgccattttgcattttatgcatttgctggtcgatcaggtgtagaacgatggagcagaaaaacagaggtggtgttcttttttttttgttttcagtgcgctctattatttgggtgttgtcaacatgcaaatatgaaacaattatttatttttaatttaaaaatgcattttcttgttttttaaaagagctgtcttttctatctggaaattcattaggtgattaagtgaactttctctgtcctccctctctgtacataactttattcagggggtagcaacttagttctagacagtatgttttgtcctgcaacagacatgaaaactgaagaaaagttatatagttaagctcacaaagttcagaacataatgagttagagcctaaatgtcaataatagattataaattatacctttgaagatattggagtcttgttgcaagcatctgcacttggattttaacgcactggtgcacaaatatgtattttttgaaaagaaaatctatcaaacaaatggaaccacctcccaaccagcataaactttagtcttttctgtctttgggtggtagtaccagatagatgttttacaatcaacatagcggtccagtttgattgaatatgtgatttacgctagtccaacatttattttgttaaatgatcttgtgtatccttgtccttttttttttcttttcttttctaattgctagtattgtgatttaattgtttagaacattgaagcagcagcttcttcagacgcatcacagttaattccacagcataactacaaacttgatgttcatgctctgaatagacgtcaacctggagaggtacttagctatagctgttcaatttaatcctaaattcctaatggtatattgaattgatggaatatggtaaattggagtggcataaaataccattccatcctttttaagcaggggaatcattgcttttctttttcatacatccattttattctaatctagaaatatgcatgttgatttttatgttctcccctttagctcaacgtactgattttgttatatgtaagtaatactgtaatttcagatttattactttttccattcctttcctcatcaatcttaagtaataccgtagaatagattcctagtcatatctttatgttcttcaccttttctcttcaaatgatcaaacactaaagcaaatatttgtttgttaatatggagtttactatgagaactctagtacaatagtactcatccaaatctacttgagtaacttggtcatctccttcctttgtgtgtggaaatagcagcatgtgcacataaaggagtgtttcaatcaaatttaatattattgtgaaacctttgtatatgtttatccatatctacccaatagatagcttcctgtgacatgtgaaattatagtttgaatgcagggaattcagagaatcaatcctgggagttatgccacatcaatgggtacactctattttcaaccttgattaacgtttggtactaaagcataatctcaaatgtcatagttaactgatattagatacatgcactcatcaggataggagagaagatactttattgaagttggtccacttcaatcggcataagaggaaaacattgaagaaaacacctggaaagactatcaattaccctttcgacaagcctgaggaaaaccatccaccagggaaggactcaaccaaaaaaatttcaaacataattgggaaagcagcaaattttgctggttcagcaaaatccaagaaggtaattagaaaccatgtcatgcaatgcaactggtaacaattcattcaattgttgacataatgataattagttttaagatggctacaactggacaactcaaaaattcttttccaaacatgatttcagctacaagcttttgttgtctttatccagtaacagagctgtctgtttactttctaactactgcatgtccaattttttgttatgtgatctaaatctttgtgttggtaatattctcagcatctgctgattttaattcattttggctaaacctattttgaatttgttatgataaccattgcttagcatttttaattttttttttaaactaagcactggtcagataaaccatctcacttgttatatttgtatttgttcttaaagatttaagtctagctacattttttatttctcatttaaattttttgaatcctgaatttagggagccaagatatttagttataaaaataatgattaataataaatatgcagttctccccattgtcgtgttaatttggtagatagcatagtagtcaatcttggatagcggtgcgtagtggccaaccccaaaaatgggatagcgtatagcggtatgacaaatagcggtcaccgatgtttgattattttttggacaattatatgaataatagcaaagtataaacaaacttatatatttctcaacaaaaaaaacttatattaaatataacactcaaatctcacgagacattcataaatcaaaacaccgaaaacaaaagacaggaacaaataaaaaaaatcataaaacaggagaaaccataagatagaagatagaagagtgtgtttcgcggcacaggtgagaagagagaaaaagttgaaaaatgttagggtttacgaaatcctcaaaatgccctaaaaaaggttttaaaaatagggtcaatttggaaatttcctactaaaataaatagcggctgctatccaacccgcaccgctatagcagctgaagcggccgctatttgattccgcgctatttgataccgctatgctacacgcggccgctatagcgccactatcggctgctattgactactatggtagatagaaactgttaggttacctagtagggctgatgatgtgttagtgggctcaagtaatgagtgagaggcccattatttggagggtgtatgaacgtgggaagaagagaggagagaagggactaagggtgcttcctagctggcagttagttagtatgaggcagagggagtgaatatatttcttctgaggagctgttgctctagtttatccgtcatagtgatttcattgttattctagtttagccaggctttgggagtatttggtatatctacctcgaagatgctaggtcctaaaatgatgcagttggaaggttcgattgcgggagtctctctgttggtgatgatttaaacacaatttcatatactcctggtgtggttgaagcgttgggggttgcctttggattcatcagatactgctggtgtgcatttgggtgggggtggggggtcatatggtgcagatattgggcaaatgtgtggttggcttctgcatatcggcccttatgcagtcttgctggatacatatgtgttggggttagaagaggtcatgccaaagtaccaattactctcttaatacctgtctaataagactctaatgctttaaattgacgaggatttgcatttttcacctttcactggcaaacatatgggttaaactggtagatgtttagcgtgttcaagtacaagctgtgttcccatagatgaagtacttcatgtttggggagtttgatcgttaaactacctaattgtttgtttaaatgaattttgaattccctcttctaataattttagtgcttccaaagattataatgcatataaaacaatttgaggattatcttgttcttaggtgaaaaacagtttttttcccatttgaaattagataaacagagtagttgtagatttctactgtggaaagcataacatgtctaagctggttaaatatacttaattgatggtttttgtcattaaagtaatttctttgcatacatttttatgttctcatgttattgcttaatcggaaaggggttctataaaatggatggcattttatgggattccgagaagcctttttcttttttttgccagggtggggggtttgcattatttgtcataatgttttttcttttggaatgcagtatccaccatatgttcccaccataaccaactatactaaggtttggtgggttcctaatgttgttgtggctcatctaaaggaggggatagaagtccttcatctggcatctggtcgaacactatgtaaggtaaatataaagccactgatcagcttgaaaatcaaaatacaaaaaaaaaaaaaaaaagtttacaagtagttgtacaacatttgctcctgtggttgtagatttgtagtattaaactgccatggtttcagccaaaatcttatttagcattcacgttacttttgaaatttttcgtattctgtgaaatgacacttctatttatctcagcttcaccttcaggaaggtggtctacatgctgatattaatggtgatggagttctggatcatgtgcaggttcactttttttccttcacattttttgataaacaaacaagccaaatctttattaatttagcatgataattgttaacttaacgggggattttcctctgcctgatgtctgaaagatttatctaatcaggctgttggaggaaatggtgctgagcaaactgtagttagtgggtccatggatgttctacgtccttgttgggctgttgcaacgtctggcgtaccagtacgggaacaactcttcaatgtatctatttgtcattatacccattttaacttattccaacatggagaactttatagaggcttcaaccgaggttcagatatgtcttctttggaggtagcaacacccattctcattcctagaagcgatggtcacaagcaccggaagggaagccacggggatgttatcttcttgacaaaccggggagaggtacgctcttttttgttcgactaaatctggttatgtaacatttgatagtttgtttgagcaccaatcaaacaaacctagttcttaacttctgttaacaaattatttcaagtcacgcacgactaatatattttggtggtatttgtgagataatccgtacctccgtactgactttatgaaaattgctccttgcagataacttcgcacactcctggtttgcatggtcatgatgctgtttggcagtggcaacaatcaactggtgtcacatggtcaaacctaccttccccagcagggatgatggaaggtggtttggtgattcccacactaaagccttttcctttgcggttgcatgacaatcatgagatgatccttgcagctggagaacaagaggctgtggtaatatcacccggaggtagcatattggctacaattgaactccctggttcacctacacatgtattgatccgtgaagacttctcaaatgatgggctcactgaccttattctcgtcacctcatccggagtgtacggctttgtccagactcgacaacctggtgctctcttcttcagtgtgctgatcggctgtctcatagtcgtgatgggaattatatttgttacccagcacataaattccatgaaggggaagcctcgtccatcatctggtcctaggtgaaatgcaggacctgaaatttatacattaactttgcaggcgcttacagatgaagcagaagacaaagcggtgtgcgcatcgtatggagcttcaagattgttggaaatgcatagaatgtaaggagattttgaggaggtgttgtactgtctaggatggatgattgtaaaatttagacagaagtgacagaatgtccttcatgagagaaacatgatccattaatataaggaaactatagtctttgcctacgtatctggctgttgtttagaagttatactgcccacacttgacaattgtcacccgttccgaattagttgatacttgatagttgatgcataacagaaactcaccttggtctttacacttttcgctaaaaggattttctcttgtcattacacaattcttgtaaatacgaccatcgtttatttgcttcagatttagcagtgtaaaacattaaatctagcaaccaacttgctccaatctgtcttggtcttcttcagaatacacttcttaaaagtcaattaagaaatgacttcctgattccatcaaattaccaatgtggttgatcccatcatacatcaagtgctatgtacgtaatccctgttagtctttggcatcaccttaagtgttttagctattgcttttcctgtgcgtcgagaaatgtttcaaataaccatctgaatgattcaatattgcatcatataatattgcaaacccaaaattagtgtgttcctataatggataaagcttgaaaataatgcgagtggtcgattagtgcgattggtgcaatgttggattcattaacaactggtattgaaaatattgcataaagctatcaacttctccatataccatgctacattgtcttttgcctgatgatgatttttgacatccaaccgtgtaaatacaatattagt

SEQ ID NO: 73 - protein, 57 aa, Medicago sativa
IQQDGGVSFKDAWMHLTDEYPIKYEAERLPPPVVADLNGDGKKEVLVATHDAKIQVL

SEQ ID NO: 74 - protein, 25 aa, Medicago sativa
LSQLHLQEGGLHADINGDGVLDHVQ

SEQ ID NO: 75 - protein, 107 aa, Medicago sativa
QAVGGNGAEQTVVSGSMDVLRPCWAVATSGVPVREQLFNVSICHYTHFNLFQHGELYRGFNRGSDMSSLEVATPILIPRSDGHKHRKGSHGDVIFLTNRGEVRSFLF

SEQ ID NO: 76 - protein, 156 aa, Medicago sativa
QITSHTPGLHGHDAVWQWQQSTGVTWSNLPSPAGMMEGGLVIPTLKPFPLRLHDNHEMILAAGEQEAVVISPGGSILATIELPGSPTHVLIREDFSNDGLTDLILVTSSGVYGFVQTRQPGALFFSVLIGCLIVVMGIIFVTQHINSMKGKPRPSS

SEQ ID NO: 77 - DNA, 1521 bp, Oryza sativa
atggccgccatgatggcgtccataaccagcgagctgctcttctttctccccttcatcctccttgccctgctcacgttctacaccaccaccgtggccaaatgccacggcgggcactggtggcgaggtgggacgacgccggcgaagaggaagcggatgaacctgccgcccggcgccgccgggtggccgctcgtcggcgagacgttcggctacctccgcgcccaccccgccacctccgtcggccgcttcatggagcagcacatcgcacggtacgggaagatataccggtcgagcctgttcggggagcggacggtggtgtcggcggacgcggggctcaaccggtacatcctgcagaacgaggggaggctgttcgagtgcagctacccgcgcagcatcggcggcatcctgggcaagtggtccatgctggtcctcgtcggggacccgcaccgcgagatgcgcgccatctccctcaacttcctctcctccgtccgcctccgcgccgtcctcctccccgaggtcgagcgccacaccctcctcgtcctccgcgcctggcccccttcctccaccttctccgctcagcaccaagccaagaagttcacgttcaacctgatggcgaagaacataatgagcatggacccgggggaggaagagacggagcggctgcggcgggagtacatcaccttcatgaagggcgtggtctccgcgccgctcaacctgcccgggacgccctactggaaggctctcaagtcgcgtgctgccattctcggagtaatagagaggaaaatggaagagcgggttgagaagctgagcaaggaggatgcaagcgtagagcaagacgatcttctcggatgggctctgaaacaatctaacctttcaaaagagcaaatcctggacctcttgctgagcttgctcttcgccgggcacgagacgtcgtccatggcgctcgccctcgccatcttcttccttgaaggctgccccaaggctgtccaagaactgagggaggagcatcttgggattgcaaggagacaaaggctaagaggggagtgcaaattgagctgggaagactacaaagagatggttttcacgcaatgtgtcataaacgagacgttgcggctaggaaacgtggtcaggttcctgcaccggaaggtcatcaaggacgtgcactacaagggttatgacattccaagcggatggaagatcctgccggtgttagccgcggtgcatctggactcgtccctgtacgaggacccccagcgcttcaatccctggagatggaagagtagcggatcatccggcggcttggctcagagcagcagcttcatgccgtacggcggcgggacgcggctgtgcgccgggtcggagctcgcgaagctggagatggccgtgttcttgcaccacctggtgctcaacttcaggtgggagctcgccgagccggaccaagccttcgtcttccccttcgtcgacttccccaagggccttcccattagggttcatagaattgcacaggatgatgagcaggagtaa

SEQ ID NO: 78 - protein, 505 aa, Oryza sativa
MAAMMASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQ

SEQ ID NO: 79 - DNA, 1542 bp, Arabidopsis thaliana
atgttcgaaacagagcatcatactctcttacctcttcttcttctcccatcgcttttgtctcttcttctcttcttgattctcttgaagagaagaaatagaaaaaccagattcaatctacctccgggtaaatccggttggccatttcttggtgaaaccatcggttatcttaaaccgtacaccgccacaacactcggtgacttcatgcaacaacatgtctccaagtatggtaagatatatagatcgaacttgtttggagaaccaacgatcgtatcagctgatgctggacttaatagattcatattacaaaacgaaggaaggctctttgaatgtagttatcctagaagtataggtgggattcttgggaaatggtcgatgcttgttcttgttggtgacatgcatagagatatgagaagtatctcgcttaacttcttaagtcacgcacgtcttagaactattctacttaaagatgttgagagacatactttgtttgttcttgattcttggcaacaaaactctattttctctgctcaagacgaggccaaaaagtttacgtttaatctaatggcgaagcatataatgagtatggatcctggagaagaagaaacagagcaattaaagaaagagtatgtaactttcatgaaaggagttgtctctgctcctctaaatctaccaggaactgcttatcataaagctcttcagtcacgagcaacgatattgaagttcattgagaggaaaatggaagagagaaaattggatatcaaggaagaagatcaagaagaagaagaagtgaaaacagaggatgaagcagagatgagtaagagtgatcatgttaggaaacaaagaacagacgatgatcttttgggatgggttttgaaacattcgaatttatcgacggagcaaattctcgatctcattcttagtttgttatttgccggacatgagacttcttctgtagccattgctctcgctatcttcttcttgcaagcttgccctaaagccgttgaagagcttagggaagagcatcttgagatcgcgagggccaagaaggaactaggagagtcagaattaaattgggatgattacaagaaaatggactttactcaatgtgttataaatgaaactcttcgattgggaaatgtagttaggtttttgcatcgcaaagcactcaaagatgttcggtacaaaggatacgatatccctagtgggtggaaagtgttaccggtgatctcagccgtacatttggataattctcgttatgaccaacctaatctctttaatccttggagatggcaacagcaaaacaacggagcgtcatcgtcaggaagtggtagtttttcgacgtggggaaacaactacatgccgtttggaggagggccaaggctatgtgctggttcagagctagccaagttagaaatggcagtgtttattcatcatctagttcttaaattcaattgggaattagcagaagatgatcaaccatttgcttttccttttgttgattttcctaacggtttgcctattagggtttctcgtattctgtaa

SEQ ID NO: 80 - protein, 513 aa, Arabidopsis thaliana
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDQPFAFPFVDFPNGLPIRVSRIL

SEQ ID NO: 81 - DNA, 1590 bp, Saccharum officinarum
  misc_feature (394)..(394): n is a, c, g, or t
atgggcgccatgatggcctccataaccagcgagctcctcttcttccttcccttcatcctgctggccctcctcgccctgtacaccaccactgtcgccaaatgcgacggcacccaccagtggcgccggccgaagaagaagcggccgaacctgcccccgggcgccctcggatggcctttcgtcggcgagaccttcggctacctccgcgcccacccggccacctccgtgggcctcttcatggagcagcatgtcgcacggtacggcaagatataccggtcgagcctgttcggggagcggacggtggtgtcggcggacgcggggctcaaccgctacatcctgcagaacgaggggcggctgttcgagtgcagctacccgcgcagcatcggcggcatcctgngcaagtggtccatgctggtgctggtgggcgacgcgcaccgcgagatgcgcgccatctcgctcaactttctcagctccgtccgcctccgcgccgtgctgctcccggaggtggagcgccacaccctgctggtgctccgctcatggccgccctccgacggcacggtctccgcgcagcaccaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcacgcgcgtccatacttggagtaatagagaggaagatggaggacaggcttcagaaaatgagtaaggagaactcaagtgtggaggaagacgatcttcttggatgggccctgaagcagtccaatctgtcaaaggaacagatcctggacctcttgctgagcctgctcttcgccgggcacgagacttcgtcaatggcgctagccctcgccatcttcttccttgaaggatgccccaaggctgttcaagaactccgggaggagcatctcgagattgctaggagacaaaggctaagaggggcgttcaaattgagctgggaagactacaaggaaatggttttcacgccatggtgtataaacgagacattgcgggttggcaacgtggtcaggttcctgcaccggaaggtcatccaagatgtgcactacaatgggtacgacataccacgcgggtggaaaatcctgccggtgttagcggcggtgcatctggattcgtcgctgtacaaggacccctaccggttcaacccttggagatggaagagcaacgcgccgagcagcttcatgccgtacggcggcgggccgcggctgtgcgccgggtcggagctggccaagctggagatcgccatcttcctgcaccacctggtgctcaacttccggtgggagctggcggagccggaccaagccttcgtctaccccttcgtcgacttccccaagggcctcccgatcagggtccagcggatcgccgacgaccagggggcatcgcagcgttttgaccgagaagcacgatgtagcggtacgggtacacaagcaagtacaaaattttcgttgcattttgagggaattggggctgggtggttatggtaa

SEQ ID NO: 82 - protein, 529 aa, Saccharum officinarum
  UNSURE (132)..(132): Xaa can be any naturally occurring amino acid
MGAMMASITSELLFFLPFILLALLALYTTTVAKCDGTHQWRRPKKKRPNLPPGALGWPFVGETFGYLRAHPATSVGLFMEQHVARYGKIYRSSLFGERTVVSADAGLNRYILQNEGRLFECSYPRSIGGILXKWSMLVLVGDAHREMRAISLNFLSSVRLRAVLLPEVERHTLLVLRSWPPSDGTVSAQHQAKKFTFNLMAKNIMSMDPGEEETERLRLEYITFMKGVVSAPLNFPGTAYWKALKSRASILGVIERKMEDRLQKMSKENSSVEEDDLLGWALKQSNLSKEQILDLLLSLLFAGHETSSMALALAIFFLEGCPKAVQELREEHLEIARRQRLRGAFKLSWEDYKEMVFTPWCINETLRVGNVVRFLHRKVIQDVHYNGYDIPRGWKILPVLAAVHLDSSLYKDPYRFNPWRWKSNAPSSFMPYGGGPRLCAGSELAKLEIAIFLHHLVLNFRWELAEPDQAFVYPFVDFPKGLPIRVQRIADDQGASQRFDREARCSGTGTQASTKFSLHFEGIGAGWLW

SEQ ID NO: 83 - DNA, 1437 bp, Allium cepa
atggagatcatattagtgtctacattgatcatatcgctactaatatttcttggatttagaagcaatgggaaaacggagagaaaattgctgcctacactaccaccaggcaatcttggaggttggccattcatcggtgacaccattccgttcatgacacctcattcttctgctttgttgggcacttacatcgatcaaaatatttccaaatatgggaggatatttcgaatgaacttgttaggaaaggcaacgatcgtgtctgtagaccctgatttcaacagatatattctacagaatgaaggaagattgtttgaaaatagctgcccaacgagcattaaagagattttgggaaaatggtctatgcttgcattagctggggatatacacagagaaatgagatccattgctgtgaatttcatgaacagtgttaagcttagaacttattttttaaaggatattgatattcaggctgttaatattcttgatgcttggaaggtcaactctactttctctgcacaggatgaaggaaagaagtttgcatttaacctcatggtgaagcatctaatgaatatggatcctggaatgccagagacagaagaaatcagaaaagagtacattttcttcatggaggggatggcttccattcctttaaactttcctggaacagcctacagaagagctttacagtcaaggtccaggattctggcaataatggggcaaaagcttgacgaaaggatgcagaaaataaaagaaggctgtaaaggactggaagaagaggatcttcttgcctcagttgcaagaaatactaacataacaagagaccagattcttgatttgatgatcagcatgctttttgctggtcatgaaacttcttctgccgctatttctcttgccatttatttcctgcaagcttcccccgatgttcttaaaaagcttcgagaggagcacataaagattgcaaaacaaaagaaagaaaggggcgaaactgaattgaactgggatgattacaagcaaatggaattcacaaactgcgttattcatgaaaccctaagattaggcaacatcgttaagtttttgcatcggaaaaccatcaaagatgttcaatacaaaggttatgaaattccatgtgggtgggaagtagtgccaatcatctcagcagcacatttggattcttctatctttgacaacccaaaagttatgaatccttcgaggtgggaggcgatattttcagcaggagcaaagagcaatataatgtcattcagcggtggacctcggttatgtccaggagcagagttggcgaaactggagatggctatttttcttcatcatcttgtacagaggttcgactgggaattggtggagaaggataaccctgtatcattccccttccttggatttcccaagaaattgcctatcaaaatcacagctcttaaacattga

SEQ ID NO: 84 - protein, 478 aa, Allium cepa
MEIILVSTLIISLLIFLGFRSNGKTERKLLPTLPPGNLGGWPFIGDTIPFMTPHSSALLGTYIDQNISKYGRIFRMNLLGKATIVSVDPDFNRYILQNEGRLFENSCPTSIKEILGKWSMLALAGDIHREMRSIAVNFMNSVKLRTYFLKDIDIQAVNILDAWKVNSTFSAQDEGKKFAFNLMVKHLMNMDPGMPETEEIRKEYIFFMEGMASIPLNFPGTAYRRALQSRSRILAIMGQKLDERMQKIKEGCKGLEEEDLLASVARNTNITRDQILDLMISMLFAGHETSSAAISLAIYFLQASPDVLKKLREEHIKIAKQKKERGETELNWDDYKQMEFTNCVIHETLRLGNIVKFLHRKTIKDVQYKGYEIPCGWEVVPIISAAHLDSSIFDNPKVMNPSRWEAIFSAGAKSNIMSFSGGPRLCPGAELAKLEMAIFLHHLVQRFDWELVEKDNPVSFPFLGFPKKLPIKITALKH

SEQ ID NO: 85 - DNA, 1491 bp, Zinnia elegans
atgtgttcaacaaccctaaatatgtgtgaccttgagttcttcatccttgcatcttgtcttgtcttggctctttttctcatcttgaagcttgtcaaaagaagaacaaacaatggttcgactcgaaatcttccaccgggcaacatgggctggccgttcatcggtgaaaccatcggttacctccaaccgtattcggctacaaccatcggcaagtttatggaacaacacatatccaagtatgggaagatatacaaatctagtttgtttggtgagccaacaatagtttctgctgatccagggttgaataagtacatattgcaaaatgaagggaggttatttgaatgtagttatccaagaagcatagggggtattcttggcaaatggtccatgttggttttggttggtgacatgcatagagacatgaggcaaatttcactcaactttttgtccaatgcaaggcttaaaactcaactagtaaatgaagttgagaaaaatactttgtgggtattagattcttggaaagaaaactcacctttttgtgcccaagaagaagccaagaagtttacttttaatctaatggcaacacatatcatgagtttagacccgggtgaaccggagaccgagcgattgaagaaagagtatgtaactttcatgaaaggtgtggtttctccccctttaaacttccctggaactgcatactggaaagctttaaagtctcgagcgacgattcttaaattcatcgaaacaaaaatggaggagcggattaggatggacgaaggaaacggattagggaaactagacaatgatcttcttggatggtctatgaagaactcaaatctcactaaagagcaaatactcgatttggtattgagtctactctttgctggtcacgaaacgtcttcggtttcgatatcgttagccgtttacttccttgaagcttgtcctaccgcggttcgtcaacttagagaagaacatgaagaaattgtgatgaaaaaaaagctattgggtgagaagtatctcacttgggatgactacaaaaagatggagtttactcagtgtgtgatcaatgagacgctaagattcgggaatgtggtgagattcctccacagaaaggctattaaagatgtgaggtataaaggatatgacattccatgtggttggaaagtgctgccagtgattgcagccgtgcatttggatcctacacattttgaccaaccttacctttttgatccatggagatggcagaacgcaagtgtcacgtcatctacttgttcaaccccgccatcagcaagtaacttcatgccatttggtggagggccccgcttatgcacagggtcagagctagcgaaactagagatggcgatatttatccaccatttggtcctaaaatacgagtgggaattggttgactcagatgaagcattcgcttatccatatctcgactttccaaaaggtctgccaatcaaaatccgtcaccgaaaacaatcatgttag

SEQ ID NO: 86 - protein, 496 aa, Zinnia elegans
MCSTTLNMCDLEFFILASCLVLALFLILKLVKRRTNNGSTRNLPPGNMGWPFIGETIGYLQPYSATTIGKFMEQHISKYGKIYKSSLFGEPTIVSADPGLNKYILQNEGRLFECSYPRSIGGILGKWSMLVLVGDMHRDMRQISLNFLSNARLKTQLVNEVEKNTLWVLDSWKENSPFCAQEEAKKFTFNLMATHIMSLDPGEPETERLKKEYVTFMKGVVSPPLNFPGTAYWKALKSRATILKFIETKMEERIRMDEGNGLGKLDNDLLGWSMKNSNLTKEQILDLVLSLLFAGHETSSVSISLAVYFLEACPTAVRQLREEHEEIVMKKKLLGEKYLTWDDYKKMEFTQCVINETLRFGNVVRFLHRKAIKDVRYKGYDIPCGWKVLPVIAAVHLDPTHFDQPYLFDPWRWQNASVTSSTCSTPPSASNFMPFGGGPRLCTGSELAKLEMAIFIHHLVLKYEWELVDSDEAFAYPYLDFPKGLPIKIRHRKQSC

SEQ ID NO: 87 - DNA, 1422 bp, Medicago trunculata
atgtctaactcatacttaacttgcagttttctttcttccatctttgttctttctttgattttcattttcatcaaaagaaagaaaacaaggtataatcttccacctggaaaaatgggatggccctttataggagaaaccattggttatttgaagccttacactgccaccacaatgggagaatttatggaaaatcacatagcaaggtatgggacaatttacaagtcaaatttgtttggagggccagctattgtatcagcagatgcagaattgaataggttcatattacaaaatgatggaaaattgtttgagtgtagctatccaaaaagcattggtggaatacttggaaaatggtcaatgttggttttagtaggtgacatgcatagggaaatgaggaatatatcactaaactttatgagctatgctaggcttaaaacacattttttgaaagatatggagaagcataccctttttgttctaagctcttggaaagaaaattgtacattttcagctcaagatgaagcaaaaaagttcaccttcaatttgatggccaaacaaatcatgagtttggatccagggaatcttgagacagaacagttgaaaaaagagtatgtctgtttcatgaaaggtgttgtttctgctcctttgaatttgccaggaactgcatacagaaaagcattaaagtctaggaacaatatattgaagttcatagaggggaaaatggaagaaagggtgaagagaaaccaagaaggaaaaaaagggatggaggaaaatgatcttctaaattgggttttaaagcattcaaatctttccactgagcaaattcttgacttgattctaagtttactttttgctggccatgaaacttcatctgtggctatagctctagctatttactttttgcctagttgtcctcaagctatacaacaattaagggaagagcatagagaaatagctagatccaagaagaaagcaggggaggttgaattaacttgggatgattataaaagaatggaatttactcattgtgttgtgaatgaaacactaaggttgggtaatgttgtgagattccttcacaggaaggctatcaaagatgttcattacaaaggttatgacattccatgtggatggaaagtccttccggtgatttcagcggtacatttggatccttcaaattttgaccaacctcaacacttcaatccttggagatggcagatgagcaataacaacttcatgccatttggaggaggaccaaggctatgtgcaggattagaattagccaaacttgaaatggctgttttcattcaccatatcatcctcaaatacaactgggacatggtcgatgttgatcaacctattgtatacccttttgttgattttcccaaaggtttgccaattagagtccaaagccaagccactctttaa

SEQ ID NO: 88 - protein, 480 aa, Medicago trunculata
MSNSYLTCSFLSSIFVLSLIFIFIKRKKTRYNLPPGKMGWPFIGETIGYLKPYTATTMGEFMENHIARYGTIYKSNLFGGPAIVSADAELNRFILQNDGKLFECSYPKSIGGILGKWSMLVLVGDMHREMRNISLNFMSYARLKTHFLKDMEKHTLFVLSSWKENCTFSAQDEAKKFTFNLMAKQIMSLDPGNLETEQLKKEYVCFMKGVVSAPLNLPGTAYRKALKSRNNILKFIEGKMEERVKRNQEGKKGMEENDLLNWVLKHSNLSTEQILDLILSLLFAGHETSSVAIALAIYFLPSCPQAIQQLREEHREIARSKKKAGEVELTWDDYKRMEFTHCVVNETLRLGNVVRFLHRKAIKDVHYKGYDIPCGWKVLPVISAVHLDPSNFDQPQHFNPWRWQQNNDGASGNSNIFLPFGGGPRLCAGLELAKLEMAVFIHHIILKYNWDMVDVDQPIVYPFVDFPKGLPIRVQSQATL

SEQ ID NO: 89 - DNA, 1485 bp, Populus trichocarpa
  misc_feature (1110)..(1110): n is a, c, g, or t
atgtctcactcagagcttgttgtctttctccttccatcgattttatcactactcttgctcttcattctcgtgcaaagaaagcaagtaagatttaatctcccaccgggcaacatggggtggccatttcttggagaaaccattggctacctgaagccttactctgctacttcaataggagaattcatggaacagcacatatcaaggtatggaaagatttacaagtccaatttgtttggggagccaacaatagtatccgcagatgctggacttagcagatttatactacagaatgagggaagattatttgaatgcagctatccaaaaagtattggtggaattcttggaaaatggtccatgatggttcttgttggagacatgcatagagacatgaggattatatctctcaactttttgagccatgccaggttaagaactcatctattgaaagaagtggagaagcaaaccctgcttgttcttagctcttggaaggagaattgtacattttcagctcaagatgaagcaaacaagtttaccttcaattggatggcaaaacatatcatgagcttggatcctggaaagacagagactgagcagctgaaaaaagagtatgttactttcatgaaaggagtagtttcaggtcctataaattttcctggaaccccatatagaaaagccttgaagtctcgatcaatcatcttgaaatttatagagcgaaagatggaggagagaattggagaaacgaagggtggagtagaaaacttggaagacgatgatcttcttggatgggtcttgaagcattcaaatctttatacggagcaaatccttgaattaatcttaagcttgctctttgctggccacgaaacttcttctgtgtccatagctctagccatatccttcttgcaagcttgtcctggttctattcaacagttaaaagaagaacatattcaaatctccagagccaagaaacggtcaggagagacggaattgacctgggatgattacaaaaaaatggaattcactcaatgcgttataagcgagacagtgaggcttggaaacgtagtcaggtttgttcacagaaaagctctaaaagatgttcggtacaaagggtangacattccatgtggatggaaagtgttaccagtaatctcatccgtccatttagattcaactcttttcgaccaacctcaacacttcaatccatggagatggcagcagcacaacaatgctcgtggatcttctacttgttcgagtgcggcggcggcggcggcggcggcggtgagtagtaatcacttcatgccatttgggggaggaccgcgactctgtgcaggatcggaattggcaaaacttgaaatggcagttttcattcaccatttggttctgaacttccattgggaattggtcggtgccgatcaagcctttgcctttccttttgttgattttcctaaaggcttgccaataagagtcaagcaccacacagtcatataa

SEQ ID NO: 90 - protein, 494 aa, Populus trichocarpa
  UNSURE (370)..(370): Xaa can be any naturally occurring amino acid
MSHSELVVFLLPSILSLLLLFILVQRKQVRFNLPPGNMGWPFLGETIGYLKPYSATSIGEFMEQHISRYGKIYKSNLFGEPTIVSADAGLSRFILQNEGRLFECSYPKSIGGILGKWSMMVLVGDMHRDMRIISLNFLSHARLRTHLLKEVEKQTLLVLSSWKENCTFSAQDEANKFTFNWMAKHIMSLDPGKTETEQLKKEYVTFMKGVVSGPINFPGTPYRKALKSRSIILKFIERKMEERIGETKGGVENLEDDDLLGWVLKHSNLYTEQILELILSLLFAGHETSSVSIALAISFLQACPGSIQQLKEEHIQISRAKKRSGETELTWDDYKKMEFTQCVISETVRLGNVVRFVHRKALKDVRYKGXDIPCGWKVLPVISSVHLDSTLFDQPQHFNPWRWQQHNNARGSSTCSSAAAAAAAAVSSNHFMPFGGGPRLCAGSELAKLEMAVFIHHLVLNFHWELVGADQAFAFPFVDFPKGLPIRVKHHTVI

SEQ ID NO: 91 - DNA, 1407 bp, Aquilegia formosa x Aquilegia pubescens
  misc_feature (1031)..(1032): n is a, c, g, or t
atgcctgagcttgtgtttttcttttcattagctccagcaattttagcactaatacttctcttgaaactcttcaaaaggaagaaaaagtcatataatcttccaccaggaaacatgggttggccatatctaggcgaaactcttggttatttgaagccttattgtgctatcactactggagatttcatggagcaacatatatcaaggtatgggaagatctacaagtcaaatttatttggttatcctacaatagtttcagttgatcctgaattaaatcgatatgtattacaaaacgaaggaagactgtttgaatgtagttatccaagtagtttaggtgggattcttggcaaatggtcaatgttagttttggttggagacatgcataaaaacatgaggatgatctctgtcaacttcatgagcagcgcaagacttcgaacacatctaattcaagatgtggagactcaagccttattggtgctgaaatcttggcaggttgataaaaagattttggcccaagatgaagcaaagaagtttaccttcaatttaattgtaaaaaatataatgagcatggaacctggaacacctgaaagtgagaagcttaggagggaatacattacattcatgaaaggaatcatttctgcgcctttgaatttgcctggaactgcatatagaagagccttaaagtctcgatcgaacattctgcaacttatcgagcataacatgaatgagagactccaaaagactaacggagatggtaagaaagtggaagatgatgatctacttggatgggtcttgaagcattcaaatcttaccactgaacaaattcttgatttgatactaagtatgcttttcgcgggtcatgaaacttcctcagtatctatatctctagccatataccttttgcaaggatgcctaaaagcagttgaagagttaagggaagagcatattagaattgctaaagcaaaagaacaggcaggacagagatctggattaaattgggaagattacaaacacatggaattcactcaatgtgnntttcttcatagaaaaactctcaaagatgttcagtacaaagggtatgacattccatgtggttggaaagttcttccagtatttgcagcagttcatttggaccctttaaatttcgaccaacctcatgctttcaatccatggagatggcagaatgggaagacaagcacgacgactaacaacttcatgccgtttggtggtggattacggttatgtgctggttcagagctagccaagttggaaatggctattttcattcaccatttggtcttgaattatgattgggatatagcagaaccagatcaaccatttgcctacccatttgttgaatttccaaaaggtctaccaattaaggtctatgaccatcagtgcttaacatga

SEQ ID NO: 92 - protein, 468 aa, Aquilegia formosa x Aquilegia pubescens
  UNSURE (344)..(344): Xaa can be any naturally occurring amino acid
MPELVFFFSLAPAILALILLLKLFKRKKKSYNLPPGNMGWPYLGETLGYLKPYCAITTGDFMEQHISRYGKIYKSNLFGYPTIVSVDPELNRYVLQNEGRLFECSYPSSLGGILGKWSMLVLVGDMHKNMRMISVNFMSSARLRTHLIQDVETQALLVLKSWQVDKKILAQDEAKKFTFNLIVKNIMSMEPGTPESEKLRREYITFMKGIISAPLNLPGTAYRRALKSRSNILQLIEHNMNERLQKTNGDGKKVEDDDLLGWVLKHSNLTTEQILDLILSMLFAGHETSSVSISLAIYLLQGCLKAVEELREEHIRIAKAKEQAGQRSGLNWEDYKHMEFTQCXFLHRKTLKDVQYKGYDIPCGWKVLPVFAAVHLDPLNFDQPHAFNPWRWQNGKTSTTTNNFMPFGGGLRLCAGSELAKLEMAIFIHHLVLNYDWDIAEPDQPFAYPFVEFPKGLPIKVYDHQCLT

SEQ ID NO: 93 - DNA, 641 bp, Triticum aestivum
atggccgccatcatggcctccataaccagcgagctccttttcttcctccccttcatcctcctggccctgctcaccttctacaccagcgccgtggctaaatgccatggcctccactggtggagcggccggacgaagaagaggcggccgaacctgccgcccggcgccgtcggctggcccttcatcggcgagaccttcgggtacctccgcgcccacccggccacctccatcggccagttcatggaccagcacatcgcacggtacgggaagatataccggtcgagcctgttcggggaccggacggtggtgtcggcggacgcggggctgaaccggtacatcctgcagaacgaggggcggctgttcgagtgtagctacccgcggagcatcggcggcatccttggcaaatggtcgatgctggtgctcgtcggcgacccccaccgcgagatgcgcttcatctccctcaacttcctcagctccgtccgcctccgcgccgtgctcctcccggaggtggagcgccacaccctcctcgtcctccgcgactggctgccttactcctcctcctccgtcttctccgcgcagcacgaagccaagaagttcacgtttaacctgatggcgaagaacatcatgagcatggaccccggcga

SEQ ID NO: 94 - protein, 213 aa, Triticum aestivum
MAAIMASITSELLFFLPFILLALLTFYTSAVAKCHGLHWWSGRTKKRRPNLPPGAVGWPFIGETFGYLRAHPATSIGQFMDQHIARYGKIYRSSLFGDRTVVSADAGLNRYILQNEGRLFECSYPRSIGGILGKWSMLVLVGDPHREMRFISLNFLSSVRLRAVLLPEVERHTLLVLRDWLPYSSSSVFSAQHEAKKFTFNLMAKNIMSMDPG

SEQ ID NO: 95 - DNA, 791 bp, Triticum aestivum
ggaaggccctcaagtcgcgagccaccatacttggagtaatagagaggaaaatggaggaaaggcttgagaaaatgaataaggaggcctcgagcatggaagaagatgatcttctcgggtgggcgatgaagcagtccaatctttcgaaagaacaaatattggacctcttgctgagcttgctgtttgccgggcatgagacatcgtcaatggcgctcgccctcgccatcttcttcctcgaaggttgccctaaagccgttgaagaactgcgggaggagcatcttgagattgctaggagacagaagctgagaggggagtgcaaactgagctgggaagactacaaagagatggttttcacgcaatgcgttataaacgagaccttgcggctaggcaacgtggtcaggttcctgcaccggaaggtcattcgagatgtgcactacaatgggtatgacatcccgagcggatggaaaattctgccggtgttagcggcggtgcatctcgactcgtcgctgtacgaggaccccagcagcttcaacccttggagatggaagggcaacgcgtccggcgtggcgcagaacagtaacttcatgccctacggcggcggcacgaggctctgcgccgggtcggagctcgccaagctcgagatggccatcttcctgcaccacctggtgctcaacttccggtgggagctcgccgagcccgaccaggcgttcgtgtacccgttcgtcgacttccccaagggcctgcccatcagggtccataggattgcacaggaagaagaaggagaagaggagtaa

SEQ ID NO: 96 - protein, 261 aa, Triticum aestivum
KALKSRATILGVIERKMEERLEKMNKEASSMEEDDLLGWAMKQSNLSKEQILDLLLSLLFAGHETSSMALALAIFFLEGCPKAVEELREEHLEIARRQKLRGECKLSWEDYKEMVFTQCVINETLRLGNVVRFLHRKVIRDVHYNGYDIPSGWKILPVLAAVHLDSSLYEDPSSFNPWRWKGNASGVAQNSNFMPYGGGTRLCAGSELAKLEMAIFLHHLVLNFRWELAEPDQAFVYPFVDFPKGLPIRVHRIAQEEEGEE

SEQ ID NO: 97 - DNA, 789 bp, Euphorbia esula
  misc_feature (325)..(326): n is a, c, g, or t
agcatggaccctggaaaaccagagactgaaaagctcaagaaagaatatgttactttcatgaaaggagttgtttctgctcctattaatttgcctggaactgcttatagaagggccttacagtctcgatcgacaattttgaagttcatagaggagaaaatggaggaaagaaatgaaaaattaaaagaaggaaaagcagaggaagaagaagaagatgatcttctaggatgggttttaaagcattcaaatctttcaactgagcaaattctagatttggtattaagtttaatgtttgctggccatgaaacttcttcagtagcaattcttnnagctatctattttttgcaagattctcctgctgctcttcaacagctaagggaagaacataaggaaattgaaaaagccaagaagcagtcaggagagaagggattgaactgggatgtttacaaaaatatggaattcactcagtgtgttatcaatgaaacactaagacttggaaatgtagtcaggttccttcataggaagactattaaacacgttcaatacaaaggatatgacattccacgtggatggaaagtgctgccagtgattgcagccgtgcatttggacagtagccattttgagaagcctcaacacttcaatccatggagatggttgcaccagaataatgggatacaaaatatgaataataatttcatgccatttgggggaggaccaagattatgtgcaggatcagaattagcaaaactagaaatggctatttttattcatcatttggtccttaattaccag

SEQ ID NO: 98 - protein, 263 aa, Euphorbia esula
  UNSURE (109)..(109): Xaa can be any naturally occurring amino acid
SMDPGKPETEKLKKEYVTFMKGVVSAPINLPGTAYRRALQSRSTILKFIEEKMEERNEKLKEGKAEEEEEDDLLGWVLKHSNLSTEQILDLVLSLMFAGHETSSVAILXAIYFLQDSPAALQQLREEHKEIEKAKKQSGEKGLNWDVYKNMEFTQCVINETLRLGNVVRFLHRKTIKHVQYKGYDIPRGWKVLPVIAAVHLDSSHFEKPQHFNPWRWLHQNNGIQNMNNNFMPFGGGPRLCAGSELAKLEMAIFIHHLVLNYQ

SEQ ID NO: 99 - DNA, 955 bp, Gossypium hirsutum
atgcctgactcagagcctattttcttgcttcttccatctattttatctttgattctgttcttcattctcatcaagagaaagcaaagaaggtataatcttccaccagggaacatggggtggccttttctcggcgaaacaatcggttacttgaggccttactctgctacttcagtaggtgaattcatgcaccagcatatatcaaggtatgggaatatctacaaatcgaatttgtttggtgagaagacaatagtgtctgcagatgctgggttgaacaagttcatattacaaaacgaagggagattattcgagtgcagttacccgagaagcattggtggcattcttgggaaatggtcgatgctggttttggttggggatatgcatagagacatgaggattatatcactcaacttcttgagcaacgccaggctgaggactcatcttttgagagaagtggagaaacatactttgcttgttctaaatacttggaaagagaagtgcatattttcagctcaggatgaagcaaaaaagttcactttcaatttgatggcaaaaaatatcatgagcatggaccctggacatccagagacggagcagctaaagaaagaatatgttactttcatgaaaggagtcgtttctgctcctttaaatttacctggaactgcatacagaaaagccttacaatctcgatcaacaatcctgaaatttattgaaaagaaaatggaagtaaggataaggaaaatgaaggaaggaaaagaaaactcagaggaagatgatcttcttgaatgggtcttaaagcattctaatctttccacagagcaaatccttgacttgattttgagcttgctttttgctggacatgagacttcctcggtagccataaccttagccatctacttcttgccaggttgtcctttggccattcaacagttgagagaggaacaccttgaagttgcag

SEQ ID NO: 100 - protein, 333 aa, Gossypium hirsutum
  UNSURE (326)..(326): Xaa can be any naturally occurring amino acid
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLMAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLRENTLKLQSQTNQRDXLNWDDTE

SEQ ID NO: 101 - DNA, 832 bp, Lycopersicon esculentum
atgggttggccttttcttggtgaaactattggctatttgagaccttattcagctactactattggagatttcatgcaagatcatatctctaggtatgggaaaattttcaagtcaaatttgtttggagagccaacaatagtttcagcagatgcagggctaaacagatacattctgcagaatgaagggagattatttgagtgtaattatccaagaagtataggtgggatacttggtaaatggtctatgttagttcaagttggacaaatgcatagagatatgaggatgatttctctgaattttttgagcaatgctaggctaaggaatcaacttttaagtgaagttgaaaagcatactttgcttgttcttggctcttggaaacaggattctgttgtttgtgcacaagatgaagcaaagaagttaacattcaactttatggcagagcatatcatgagtctacaacctggaaatccagagacagagaagctgaaaaaagagtacatcacatttatgaaaggagtggtttctgctccattgaattttccaggaacagcttacagaaaggccttacagtctcgatcaacaattcttggatttattgagagaaaaatggaggagaggcttaaggaaatgaacagaaacgaaaacgaccttctaggttgggttctgaagaattcaaatctctcaaaagagcaaattcttgatttgctactgagtttgctctttgctggccatgaaacttcatcagtagcaatagctctgtctattttcttactcgaaagctgtcctgctgctgttcaacaattaacagaagagcacttggagatttcccggg

SEQ ID NO: 102 - protein, 277 aa, Lycopersicon esculentum
MGWPFLGETIGYLRPYSATTIGDFMQDHISRYGKIFKSNLFGEPTIVSADAGLNRYILQNEGRLFECNYPRSIGGILGKWSMLVQVGQMHRDMRMISLNFLSNARLRNQLLSEVEKHTLLVLGSWKQDSVVCAQDEAKKLTFNFMAEHIMSLQPGNPETEKLKKEYITFMKGVVSAPLNFPGTAYRKALQSRSTILGFIERKMEERLKEMNRNENDLLGWVLKNSNLSKEQILDLLLSLLFAGHETSSVAIALSIFLLESCPAAVQQLTEEHLEISR

SEQ ID NO: 103 - DNA, 711 bp, Solanum tuberosum
atgtctgacttagagttttttctttttcttgttcctccaatcttggcagtccttattattcttaatctattcaaaagaaaacacaaatttcaaaatcttccaccaggggatatgggttggccttttcttggtgaaactattggttatttgagaccttactcagttactactattggagatttcatgcaagatcatatctcaaggtatgggaaaattttcaagtcaaatttgtttggagagccaacaattgtttcagcagatgcagggcttaacagatacattctgcagaatgaagggagattatttgagtgtaattatccaagaagtataggtgggatacttggtaaatggtctatgttggttcaagttggacaaatgcatagagatatgaggatgatttctctgaattttttgagcaatgctagactcaggaatcaacttttaagtgaagttgaaaagcatactgtgcttgttcttggctcttggaaacaggattctgttgtttgtgcacaagatgaagcaaagaagtttacattcaactttatggcagagcatatcatgagtctacaacctggaaatccagagacagagaagctgaagaaagagtacatcacatttatgaaaggagtggtttctgctccattgaattttccaggaacagcttacagaaaagccctacagtctcgatcaacaattcttggaattattgag

SEQ ID NO: 104 - protein, 237 aa, Solanum tuberosum
MSDLEFFLFLVPPILAVLIILNLFKRKHKFQNLPPGDMGWPFLGETIGYLRPYSVTTIGDFMQDHISRYGKIFKSNLFGEPTIVSADAGLNRYILQNEGRLFECNYPRSIGGILGKWSMLVQVGQMHRDMRMISLNFLSNARLRNQLLSEVEKHTVLVLGSWKQDSVVCAQDEAKKFTFNFMAEHIMSLQPGNPETEKLKKEYITFMKGVVSAPLNFPGTAYRKALQSRSTILGIIE

SEQ ID NO: 105 - DNA, 431 bp, Solanum tuberosum
ggaaagctgtgaaagatgttcgatacaaaggttatgacattccatgtggatggaaagtattgccggtgatttcagcagcgcatttagatccttcactttttgaccgacctcacgactttgatccttggagatggcagaatgcagaagagtcgccttcaggtaaaggaggaagcacaggcacaagcagcacaacaaaaagtagtaataatttcatgccatttgggggaggtccacgtctatgtgcaggatctgaactggccaaacttgagatggccattttcattcactatcttgttcttaattttcactggaaattagctgcacctgatcaggcttttgcctatccttacgtagattttcccaatgccctaccaatcactatccaacatcgatcgtcaaataaattaaaccaccacacttactacctctaa

SEQ ID NO: 106 - protein, 142 aa, Solanum tuberosum
KAVKDVRYKGYDIPCGWKVLPVISAAHLDPSLFDRPHDFDPWRWQNAEESPSGKGGSTGTSSTTKSSNNFMPFGGGPRLCAGSELAKLEMAIFIHYLVLNFHWKLAAPDQAFAYPYVDFPNALPITIQHRSSNKLNHHTYYL

SEQ ID NO: 107 - DNA, 52 bp, Artificial sequence
  primer: prm06540
ggggacaagtttgtacaaaaaagcaggcttaaacaatggccgccatgatggc

SEQ ID NO: 108 - DNA, 48 bp, Artificial sequence
  primer: prm06520
ggggaccactttgtacaagaaagctgggtttactcctgctcatcatcc

SEQ ID NO: 109 - DNA, 654 bp, Oryza sativa
cttctacatcggcttaggtgtagcaacacgactttattattattattattattattattattattttacaaaaatataaaatagatcagtccctcaccacaagtagagcaagttggtgagttattgtaaagttctacaaagctaatttaaaagttattgcattaacttatttcatattacaaacaagagtgtcaatggaacaatgaaaaccatatgacatactataattttgtttttattattgaaattatataattcaaagagaataaatccacatagccgtaaagttctacatgtggtgcattaccaaaatatatatagcttacaaaacatgacaagcttagtttgaaaaattgcaatccttatcacattgacacataaagtgagtgatgagtcataatattattttctttgctacccatcatgtatatatgatagccacaaagttactttgatgatgatatcaaagaacatttttaggtgcacctaacagaatatccaaataatatgactcacttagatcataatagagcatcaagtaaaactaacactctaaagcaaccgatgggaaagcatctataaatagacaagcacaatgaaaatcctcatcatccttcaccacaattcaaatattatagttgaagcatagtagta

SEQ ID NO: 110 - DNA, 1236 bp, Oryza sativa
ggtcagccaatacattgatccgttgccaatcatgcaaagtattttggctgtggccgagtgccggaattgataattgtgttctgactaaattaaatgaccagaagtcgctatcttccaatgtatccgaaacctggattaaacaatcctgttctgttctctagcccctcctgcatggccggattgtttttttgacatgttttcttgactgaggcctgtttgttctaaactttttcttcaaacttttaactttttcatcacatcagaacttttctacacatataaacttttaacttttccgtcacatcgttccaatttcaatcaaactttcaattttggcgtgaactaaacacaccctgagtcttttattgctcctccgtacgggttggctggttgagaataggtattttcagagagaaaatctagatattgggaggaacttggcatgaatggccactatatttagagcaattctacggtccttgaggaggtaccatgaggtaccaaaattttagtgtaaattttagtatctcattataactaggtattatgaggtaccaaatttacaatagaaaaaatagtacttcatggtactttcttaagtaccgtaaaattgctcctatatttaaggggatgtttatatctatccatatccataatttgattttgataagaaaaaatgtgagcacaccaagcatgtccatgaccttgcactcttggctcactcgtcaactgtgaagaacctcaaaaatgctcaatatagctacaggtgcctgaaaaaataactttaaagttttgaacatcgatttcactaaacaacaattattatctccctctgaaagatgatagtttagaactctagaatcattgtcggcggagaaagtaaattattttccccaaatttccagctatgaaaaaaccctcaccaaacaccatcaaacaagagttcaccaaaccgcccatgcggccatgctgtcacgcaacgcaccgcattgcctgatggccgctcgatgcatgcatgcttccccgtgcacatatccgacagacgcgccgtgtcagcgagctcctcgaccgacctgtgtagcccatgcaagcatccacccccgccacgtacaccccctcctcctccctacgtgtcaccgctctctccacctatatatgcccacctggcccctctcctcccatctccacttcacccgatcgcttcttcttcttcttcgttgcattcatcttgctagc

SEQ ID NO: 111 - DNA, 1455 bp, Glycine max
  misc_feature (1043)..(1044): n is a, c, g, or t
atgtctgactcactcttaactttctattctctttcagccattcttgctcttctcccaatcttcatcttcattctcatcaaaagaaagcaaagcaaacccaggctcaaccttcccccaggtaacatgggttggccatttcttggtgaaaccattggctatttgaagccttattctgccaccacagtaggggaattcatggagcaacacatagcaaggtatggtacaatttacaagtcaaaactgtttgcggggccagcaatagtgtcagcagatgcaggactcaacaggttcattctacaaaacgaagggaaattgttcgagtgcagctatcctagaagcatcggtggaatactaggaaaatggtccatgttggtcttagttggtgacatgcatagagacatgcgggttatatcactcaactttctaagccacgccaggctcagaacacacctcttgaaagaggtggagaagcaatccctcttggttctgaactcttggagccaaaattccatattctcagcccaagatgaagctaagaagttcaccttcaatttaatggctaagcatatcatgagcatggatcctggggatatcgagacagagcaactaaagaaagagtacgtcactttcatgaaaggggtggtttccgcgccattgaatttacctggaactgcataccgaaaggcattgaagtctcggtccattatactaaagttcatagaggggaaaatggaagagagagttagaagaatccaagaggggaatgagagtttggaggaagatgatcttctaaattgggttttgaagaattcaaatctttcaaccgagcaaattcttgacttgattctcagcttgctcttcgctggccatgaaacttcgtcggtagccatagctctagccatttacttcttacccggttgtcctcaagctatacaacagttaaaggaagaacacagagaaattgccagagccaaaaagcaagcaggggaagttgaactcacttgggatgactacaaacgaatggaatttactcattgtgtaannttgggaaatgttgtgaggtttctccacaggaaggctgtgaaagatgttaactataaaggttatgacattccatgtgggtggaaagtcctcccggtgattgcagccgtgcatctggatccttcactttttgaccaacctcaacacttcaatccatggagatggcagaacaatggcagtcatggaagttgtccaagcaagaacacagcaaacaacaactttcttccgttcggaggaggaccacgattatgtgcaggatcagagttagctaagcttgaaatggctgttttcattcaccatctcattctcaactaccattgggaattggctgataccgatcaagcttttgcctacccttttgtcgacttccccaaaggcctacccgttagagtccaagcccattctttactttga

SEQ ID NO: 112 - protein, 530 aa, Glycine max
  UNSURE (391)..(392): Xaa can be any naturally occurring amino acid
MSDSLLTFYSLSAILALLPIFIFILIKRKQSKPRLNLPPGNMGWPFLGETIGYLKPYSATTVGEFMEQHIARYGTIYKSKLFAGPAIVSADAGLNRFILQNEGKLFECSYPRSIGGILGKWSMLVLVGDMHRDMRVISLNFLSHARLRTHLLKEVEKQSLLVLNSWSQNSIFSAQDEAKKFTFNLMAKHIMSMDPGDIETEQLKKEYVTFMKGVVSAPLNLPGTAYRKALKSRSIILKFIEGKMEERVRRIQEGNESLEEDDLLNWVLKNSNLSTEQILDLILSLLFAGHETSSVAIALAIYFLPGCPQAIQQLKEEHREIARAKKQAGEVELTWDDYKRMEFTHCVSGMIINELWRSTCLFFYFMYSNCYYYYLMNMLVVSNIIWDDEAXXVGLGNVVRFLHRKAVKDVNYKGYDIPCGWKVLPVIAAVHLDPSLFDQPQHFNPWRWQNNGSHGSCPSKNTANNNFLPFGGGPRLCAGSELAKLEMAVFIHHLILNYHWELADTDQAFAYPFVDFPKGLPVRVQAHSLL

SEQ ID NO: 113 - DNA, 1458 bp, Gossypium hirsutum
atgcctgactcagagcctattttcttgcttctaccatctattttatctttgattctgttcttcattctcatcaagagaaagcaaagaaggtataatcttccaccagggaacatggggtggccttttctcggcgaaacaatcggttacttgaggccttactctgctacttcagtaggtgaattcatgcaccagcatatatcaaggtatgggaatatctacaaatcgaatttgtttggtgagaagacaatagtgtctgcagatgctgggttgaacaagttcatattacaaaacgaagggagattattcgagtgcagttacccgagaagcattggtggcattcttgggaaatggtcgatgctggttttggttggggatatgcatagagacatgaggattatatcactcaacttcttgagcaacgccaggctgaggactcatcttttgagagaagtggagaaacatactttgcttgttctaaatacttggaaagagaagtgcatattttcagctcaggatgaagcaaaaaagttcactttcaatttggtggcaaaaaatatcatgagcatggaccctggacatccagagacggagcagctaaagaaagaatatgttactttcatgaaaggagtcgtttctgctcctttaaatttacctggaactgcatacagaaaagccttacaatctcgatcaacaatcctgaaatttattgaaaagaaaatggaagtaaggataaggaaaatgaaggaaggaaaagaaaactcagaggaagatgatcttcttgaatgggtcttaaagcattctaatctttccacagagcaaatccttgacttgattttgagcttgctttttgctggacatgagacctcctcggtagccataaccttagccatctacttcttgccaggttgtcctttggccattcaacagttgagagaagaacaccttgaagttgccagagccaagaaccaatcaggagagactgaactcaactgggatgattacaagaaaatggagttcactcaatgtgttattaacgagacacttaggcttggtaatgtcgtcagatttctccacagaaaagctctcaaagatattagatataaaggttatgatattccatgtgggtggaaagtgcttccagtgattgcagcagtgcacttggatccctgtctttttgaccaccctcaactcttcaatccatggcgatggcagcaaaataatgggagtcgaggggcggggacggcaacgtcatcagcgagcagcagcaattacttcatgccattcgggggaggaccacggctatgtgcaggaacagagctggctaaactggaaatggcggtgttcatccaccatttggtcctcaactaccagtgggagttagccgatacggatgaagcctttgccttcccttttgtcgacttccctaaaggcctacccatcagagtcttcaaatcttaa

SEQ ID NO: 114 - protein, 485 aa, Gossypium hirsutum
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLVAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 115 - DNA, 1521 bp, Zea mays
atgggcgccatgatggcctccataaccagcgagctcctcttcttccttcccttcatcctgctggccctcctcgccttgtacaccaccaccgtcgccaaatgccacggcacccacccgtggcgccgtcagaagaagaagcggcccaacctgcccccgggcgcccgcggatggcccttggtcggcgaaactttcggctacctccgcgcccacccggccacctccgtgggccgcttcatggagcggcatgtcgcacggtacgggaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcacgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaagaggggcgtctaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtttaccctttcgtcgacttccccaagggcctcccgatcagggtccagcgggtcgccgacgaccaaggccatcgtagcgttttgaccgagagcacaagaggctga

SEQ ID NO: 116 - protein, 506 aa, Zea mays
MGAMMASITSELLFFLPFILLALLALYTTTVAKCHGTHPWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 117 - DNA, 1566 bp, Zea mays
atgggcgccatgatggcctccataaccagcgagctcctcttcttccttcccttcatcctgctggccctcctcgccttgtacaccaccaccgtcgccaaatgccacggcacccaccagtggcgccgtcagaagaagaagcggcccaacctgcccccgggcgcccgcggatggcccttggtcggcgagactttcggctacctccgcgcccacccggccacctccgtgggccgcttcatggagcggcatgtcgcacggtacgggaagatataccggtcgagcctgttcggggagcggacggtggtgtcggcggacgcggggctgaaccggtacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcctggccgcctccgaccggcaccttctccgcccagcacgaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcgcgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaaggggggcgtccaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggatcccagccggttcaacccttggagatggaaggtcagtgccctgccccctcccctcgcaaaaggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatttgactgtcctggagctacagccatcagttatcacaccagagagaaatga

SEQ ID NO: 118 - protein, 521 aa, Zea mays
MGAMMASITSELLFFLPFILLALLALYTTTVAKCHGTHQWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPPTGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKVSALPPPLAKGTSQGTSKRFTPFGGGPRLCPGSELAKVETAFFLHHLVLNYRWRIDGDDIPMAYPYVEFQRGLPIEIEPTSPEFDCPGATAISYHTREK

SEQ ID NO: 119 - DNA, 1257 bp, Brassica rapa
  misc_feature (967)..(969): n is a, c, g, or t
atgttcgaaacagagcatactctcgtgcctcttcttcttctcccatcacttctatctcttctcctcttcttgattctcttgaagagacgaagtcgacacagtttcaatctccctcctggaaaatctggatggccatttctaggcgaaaccatcggatatctcaaaccttactctgccaaaactctcggttacttcatgcaacaacatatctccaagtatgggaagatatatagatcgaatttgtttggagaaccaacgatcgtatcagctgatgcaggactcaacaggttcatattacaaaacgaaggaagactctttgaatgtagttatcctcgaagtattggtgggattcttgggaaatggtcgatgcttgttcttgttggagacatgcatagagacatgagaagtatctcgctaaactttctaagtcacgctcgtctcagaacgattcttcttaaggacgttgagaggcatactttgttcgttcttaattcttggcaacaacattctgttttctctgctcaagatgaggccaaaaagtttacgtttaatctaatggcgaagcatataatgagtatggatcctggagaagaagagacagagcagttaaagaaagagtatgtgactttcatgaaaggggttgtttctgctcctctcaatctcccaggaactgcttatcgtaaagctctccagcagtcacgagggacgatattgaagtttattgagaagaaaatggaagagagaaaatcagagattcaagaagaagacgaagaagatgaagcagagattagtagaagtgatcattatgagagaaaacatagagcagatgatgatcttttgggatgggttctaaaacattccaatctttcgactgagcaaattctcgatcttattctcagtttattatttgccggacatgagacatcatctgtagccatcgctctcgctatctactttttagcgggcnnnttgaaggaagagcatcttgaaatcgcgagggtgaagaaggaacttggagagtcagaattgaattgggatgattacaagacaatggactttactcatagtgttataaatgagactcttcgactaggaaatgtagtaaggtttttgcatcgtaaagcactcaaaaacgttcggtataaaggatacgatatcccaagtgggtggaaagtgttaccagtgatctcagccgtacatttggataactcccgttacgacgaacctaatctctttaatccttggagatggcaacag

SEQ ID NO: 120 - protein, 419 aa, Brassica rapa
  UNSURE (323)..(323): Xaa can be any naturally occurring amino acid
MFETEHTLVPLLLLPSLLSLLLFLILLKRRSRHSFNLPPGKSGWPFLGETIGYLKPYSAKTLGYFMQQHISKYGKIYRSNLFGEPTIVSADAGLNRFILQNEGRLFECSYPRSIGGILGKWSMLVLVGDMHRDMRSISLNFLSHARLRTILLKDVERHTLFVLNSWQQHSVFSAQDEAKKFTFNLMAKHIMSMDPGEEETEQLKKEYVTFMKGVVSAPLNLPGTAYRKALQQSRGTILKFIEKKMEERKSEIQEEDEEDEAEISRSDHYERKHRADDDLLGWVLKHSNLSTEQILDLILSLLFAGHETSSVAIALAIYFLAGXLKEEHLEIARVKKELGESELNWDDYKTMDFTHSVINETLRLGNVVRFLHRKALKNVRYKGYDIPSGWKVLPVISAVHLDNSRYDEPNLFNPWRWQQ

SEQ ID NO: 121 - DNA, 848 bp, Hordeum vulgare
atggccgccatgatggcatccataaccagcgagctccttttcttcctccccttcatcctcctggccctgctcaccttctacaccagcagcgtggccaaatgccatggcctccaccggtggagcggccggacgaagaagaagcggccgaatctgccgcccggcgccgccggctggcctttcgtcggcgagaccttcgggtacctccgcgcccacccggccacctccatcggccagttcatgaaccagcacatcgcacggtacgggaagatataccggtcgagcctgttcggggagcggacggtggtgtcggcggacgcggggctgaaccggtacatcctgcagaacgaggggcggctgttcgagtgcagctacccgcggagcatcggcggcatcctgggcaaatggtccatgctggtgctcgtgggcgacccccaccgcgagatgcgctccatctccctcaacttcctcagctccctccgcctccgcgccgtgctcctcccggaggtggagcgccacaccctcctcgtcctccgcgactggctgccttcctcctcctccgccgtcttctccgcccagcacgaagccaagaagttcacgtttaacctgatggcgaagaacatcatgagcatggaccccggcgaggaggagacggagcggctgaggctcgagtacatcaccttcatgaagggggtggtgtccgcgcccctcaacttccccgggacggcctactggaaggccctcaagtctcgagccaccatacttggggtaatagagaggaaaatggaggataggctcgagaaaatgaacaaggaggcctcgagcatgaagaagatatctctcggggggcg

SEQ ID NO: 122 - protein, 282 aa, Hordeum vulgare
MAAMMASITSELLFFLPFILLALLTFYTSSVAKCHGLHRWSGRTKKKRPNLPPGAAGWPFVGETFGYLRAHPATSIGQFMNQHIARYGKIYRSSLFGERTVVSADAGLNRYILQNEGRLFECSYPRSIGGILGKWSMLVLVGDPHREMRSISLNFLSSLRLRAVLLPEVERHTLLVLRDWLPSSSSAVFSAQHEAKKFTFNLMAKNIMSMDPGEEETERLRLEYITFMKGVVSAPLNFPGTAYWKALKSRATILGVIERKMEDRLEKMNKEASSMKKISLGG

SEQ ID NO: 123 - DNA, 1200 bp, Lotus japonicus
atgtctgactcatacctcactttctgttttctttcttccattcttgctctcactgtaatcatcattttcatgaaaagaaagaaggcaaggcttaaccttccccctggaaaaatgggatggccctttcttggggaaaccattgggtacttgaagccatactctgctaccacagtaggagattttatggaaaagcacatagcaaggtatggtacaatttacaagtcaaaattgtttggtgagcctgcaatagtttctgcagatgcagagttgaacaggttcatattacagaacgaagggaagctgtttgagtgcagctatccaagaagcattggaggaatacttggaaaatggtccatgttggtcttagttggggacatgcatagggacatgagaaacatttcactgaactttctgagccttgctaggctcaaaacacatctattgaaagaagtggagaagcactctcttctagttctaggctcttggaaagaaaattgtacattctcagctcaagatgaagcaaagaagttcacattcaatttgatggcgaaacatatcatgagcttggatcctgggaatctagagacagaacagctgaagaaagagtatgtctctttcatgaatggtgtggtgtctgcacctttgaattttcccggaactgcatacagaaaagcattaaagtctaggtccaccatactgaagttcatagagggaaaaatggaagaaaggatcaaaagaaaccaaaatttggaggaagatcttctaaactgggttgtgatgcattcaaatctttcaactgagcaaattcttgacctggttctgagcttgctctttgcaggccatgaaacttcatctgtggctatagctttagctatttactttttgccaggttgtcctaaagctatacaacaattaagggaagaacatagagaaatagccaggtccaagaagcaagcaggggaggttgaattaacttgggatgattacaaaagaatggagtttactcaatgtgtagttgtgaatgaaacactgaggttgggaaatgttgtgaggttccttcacaggaaggctctgaaagatgttcggtacaaaggttatgacattccacgtgggtggaaagtcctccctgtgatttcagctatgcatctggatcctgcacttttttaccaacctcaacacttcaatccatggagatggaag

SEQ ID NO: 124 - protein, 400 aa, Lotus japonicus
MSDSYLTFCFLSSILALTVIIIFMKRKKARLNLPPGKMGWPFLGETIGYLKPYSATTVGDFMEKHIARYGTIYKSKLFGEPAIVSADAELNRFILQNEGKLFECSYPRSIGGILGKWSMLVLVGDMHRDMRNISLNFLSLARLKTHLLKEVEKHSLLVLGSWKENCTFSAQDEAKKFTFNLMAKHIMSLDPGNLETEQLKKEYVSFMNGVVSAPLNFPGTAYRKALKSRSTILKFIEGKMEERIKRNQNLEEDLLNWVVMHSNLSTEQILDLVLSLLFAGHETSSVAIALAIYFLPGCPKAIQQLREEHREIARSKKQAGEVELTWDDYKRMEFTQCVVVNETLRLGNVVRFLHRKALKDVRYKGYDIPRGWKVLPVISAMHLDPALFYQPQHFNPWRWK

SEQ ID NO: 125 - DNA, 1092 bp, Malus domestica
agagacatgaggatgatatctctcaacttcttgagccatgccagactcagaacccatctgatgagagaagttgaaaagcacactcttcttgttttggggagttggaaggaaaactctgttttttcagctcaggatgaagctaagaagttcacgttcaacttgatggccaaacatatcatgagcttggatcctggaaaaccagagactgagcagctgaagaaattgtatgttactttcatgaaaggtgtggtttctcctcctctgaatttaccaggaacagcttacagaagagccttacagtcaagatcaacgattctgaagtttatagagtgcaaaatgaaagaaagattgatggagggaaccgaaaacattggggaagatgatctgcttggatgggttctgaagaattcaaatctttcaaaggagcaaattcttgacttaatattgagcttgctctttgctggccatgaaacttcatcagtgtctatagccttagcaatttactttttaccaagctgccctaatgcaattctgcagttaagggaagaacacagtgaaattgccaaagccaagaaactggcaggcgagacagagttgaattgggaggactacaagaaaatggagttcaccgaatgtgtaatctgtgagacacttcggcttgggaatgtggtgagatttttacacagaaaggctctgaaggatgttcggtacaaagggtatgacattccatctgggtggaaagtgcttccggtgattgcagccgtgcatttggatcctttactttttgaccacccgcaacacttcaatccatggagatggcagcagaataacaaccaccaccaccgtggatcatcgtcgtcatcatcatgctacacgagcatgacaagtcacaactttatgccatttgggggaggaccacgactttgcgccggttcagaattggccaaacttgaaatggccgtgttcatccaccaccttgtcctcaacttccactgggagttagccgatcctttcgacaaaccttttgctttccccttcgtcgatttccaaaatggcctaccaatcacagcccaccgctacgtaccaaactaa

SEQ ID NO: 126 - protein, 363 aa, Malus domestica
RDMRMISLNFLSHARLRTHLMREVEKHTLLVLGSWKENSVFSAQDEAKKFTFNLMAKHIMSLDPGKPETEQLKKLYVTFMKGVVSPPLNLPGTAYRRALQSRSTILKFIECKMKERLMEGTENIGEDDLLGWVLKNSNLSKEQILDLILSLLFAGHETSSVSIALAIYFLPSCPNAILQLREEHSEIAKAKKLAGETELNWEDYKKMEFTECVICETLRLGNVVRFLHRKALKDVRYKGYDIPSGWKVLPVIAAVHLDPLLFDHPQHFNPWRWQQNNNHHHRGSSSSSSCYTSMTSHNFMPFGGGPRLCAGSELAKLEMAVFIHHLVLNFHWELADPFDKPFAFPFVDFQNGLPITAHRYVPN

SEQ ID NO: 127 - DNA, 748 bp, Vitis vinifera
agacttcatggagcaacacatatcaaggttcggagaaatctacaagtccaatctgtttggcgagccaaccatagtctcagcggattctgggctgaacagattcatactacagaacgaaggaaaattgtttgaatgcagctatcccagaagcataggtggaattcttgggaaatggtccatgctggttttagttggagacatgcatagagacatgagaaccatctccctcaacttcttgagccatggcaggcttaggactcatctcctaccagaggtggtgaagcacactttgcttgttctaagctcttggaaggagaattgtacattttctgctcaagatgaagctaagaagtttaccttcaatctgatggcaaaacatatcatgagcttggatcccggaaagccggagactgagcagcttaagaaagagtatgttactttcatgaaaggagtggtatctgctcctttgaatttccctggaactgcatacagaaaagccctacagtctcggtccaccatcttaaaatttatcgagctgaagatggaagagaggattcagaaactgaggggaggagggtttgagaatatggaggatgacgatcttcttggatgggtgctgaagcattccaacctttcaactgagcaaatcctggacttggtactgagcttgctctttgctggccatgaaacttcatcagtggcaatagctttagctatctacttcttggaaggctgtcccaacgccgtt

SEQ ID NO: 128 - protein, 248 aa, Vitis vinifera
DFMEQHISRFGEIYKSNLFGEPTIVSADSGLNRFILQNEGKLFECSYPRSIGGILGKWSMLVLVGDMHRDMRTISLNFLSHGRLRTHLLPEVVKHTLLVLSSWKENCTFSAQDEAKKFTFNLMAKHIMSLDPGKPETEQLKKEYVTFMKGVVSAPLNFPGTAYRKALQSRSTILKFIELKMEERIQKLRGGGFENMEDDDLLGWVLKHSNLSTEQILDLVLSLLFAGHETSSVAIALAIYFLEGCPNA

SEQ ID NO: 129 - DNA, 1737 bp, Arabidopsis thaliana
atgcaacaactgtcaacttccctcggcttaaacacttacaacgaggaacgtaattcaacttctactaaaaacacgagttctgaagattatagtccaaggcagtctaaacacacacaaagccatggccttaaagatatctccggaaatttccattctcatggagttaatggaggtgtttcgaacatgtcattctataatacgccttcgccagtggctgcacagctatccggtatagctccaccaccacttttccggaattttcagccagctgttgcaaacccaaactcccttattactgacagttctccaaagtccactgttaactctactcttcaagcacctagaagaaagtttgtagatgaaggaaagttacgtaagatttctggcagactattttctgattctggtccacgacggagttcaagactgtctgctgattcaggggcaaacattaattcaagtgttgcaacagtaagcggaaatgtgaacaacgcttccaagtatttgggaggttctaaattgagttctttggcacttcgttctgtaacacttcggaagggacactcctgggcaaatgaaaacatggatgaaggggtccgtggggaaccttttgatgattcaaggcctaatactgcctcaacgactggttctatggcttccaatgatcaagaagacgaaacaatgtcgattggtggcatagcaatgagttctcaaacaatcacaattggtgtttcggaaattttaaacctccttaggacactcggagaagggtgtagactttcatacatgtacaggtgtcaggaggcactggatacgtatatgaaacttccacataagcattataatacaggatgggttctttcccaggtcgggaaagcatactttgaactaattgactatttagaggctgaaaaggcattccgtcttgcccgtctggcttctccttattgcttagaaggaatggatatatactctacggtcctctatcatttgaaggaagacatgaagctgagttacttggctcaggaactaatatcaaccgatcgcttagctcctcaatcttggtgtgctatgggaaattgctatagcttgcaaaaggaccatgagaccgcactgaagaatttcctacgagctgttcaactgaatccaagatttgcatatgcacataccttatgtggccacgaatacacaactcttgaggattttgagaacggaatgaaaagttaccaaaacgcacttcgtgtagatacaagacactacaacgcatggtacgggcttggaatgatatatctacgccaagagaagttagagttctcagagcatcacttcagaatggctttcctaataaacccgagttcctctgttataatgtcttatttagggacatctttgcatgccttgaagagaagtgaggaagcactagagataatggagcaagccatagtagcagatagaaaaaaccctcttccaatgtaccagaaagctaacatacttgtctgcttagaaagattagatgaagctctagaagttcttgaggagctcaaagagtatgcgccttcagagagcagcgtttacgctttaatgggcaggatctataagcggcgaaacatgcacgataaagccatgcttcatttcggtctagctttagatatgaaaccgcctgcaactgacgttgctgcaataaaggctgcaatggagaaattgcatgttccagatgagatcgatgagagcccgtga

SEQ ID NO: 130 - protein, 578 aa, Arabidopsis thaliana
MQQLSTSLGLNTYNEERNSTSTKNTSSEDYSPRQSKHTQSHGLKDISGNFHSHGVNGGVSNMSFYNTPSPVAAQLSGIAPPPLFRNFQPAVANPNSLITDSSPKSTVNSTLQAPRRKFVDEGKLRKISGRLFSDSGPRRSSRLSADSGANINSSVATVSGNVNNASKYLGGSKLSSLALRSVTLRKGHSWANENMDEGVRGEPFDDSRPNTASTTGSMASNDQEDETMSIGGIAMSSQTITIGVSEILNLLRTLGEGCRLSYMYRCQEALDTYMKLPHKHYNTGWVLSQVGKAYFELIDYLEAEKAFRLARLASPYCLEGMDIYSTVLYHLKEDMKLSYLAQELISTDRLAPQSWCAMGNCYSLQKDHETALKNFLRAVQLNPRFAYAHTLCGHEYTTLEDFENGMKSYQNALRVDTRHYNAWYGLGMIYLRQEKLEFSEHHFRMAFLINPSSSVIMSYLGTSLHALKRSEEALEIMEQAIVADRKNPLPMYQKANILVCLERLDEALEVLEELKEYAPSESSVYALMGRIYKRRNMHDKAMLHFGLALDMKPPATDVAAIKAAMEKLHVPDEIDESP

SEQ ID NO: 131 - DNA, 2235 bp, Arabidopsis thaliana
atggaagctatgcttgtggactgtgtaaacaacagtcttcgtcattttgtctacaaaaatgctattttcatgtgcgagcgtctctgcgctgagtttccttctgaggttaatttgcagctattagccaccagctacctgcagaataatcaagcttacagtgcatatcatctgctaaagggaacacaaatggctcagtcccgatacttgttcgcattatcatgcttccagatggaccttctcaatgaagctgaatctgcactctgccctgttaatgaacctggtgcggagatcccaaatggtgcagcaggccattaccttcttggacttatttacaagtatactgatagaaggaagaatgctgctcaacaatttaaacagtccttgacaatagaccctctactttgggctgcatatgaggaattatgtatattaggtgctgctgaggaagcaactgcagtttttggtgaaacagctgctctctccattcaaaagcagtatatgcaacaactgtcaacttccctcggcttaaacacttacaacgaggaacgtaattcaacttctactaaaaacacgagttctgaagattatagtccaaggcagtctaaacacacacaaagccatggccttaaagatatctccggaaatttccattctcatggagttaatggaggtgtttcgaacatgtcattctataatacgccttcgccagtggctgcacagctatccggtatagctccaccaccacttttccggaattttcagccagctgttgcaaacccaaactcccttattactgacagttctccaaagtccactgttaactctactcttcaagcacctagaagaaagtttgtagatgaaggaaagttacgtaagatttctggcagactattttctgattctggtccacgacggagttcaagactgtctgctgattcaggggcaaacattaattcaagtgttgcaacagtaagcggaaatgtgaacaacgcttccaagtatttgggaggttctaaattgagttctttggcacttcgttctgtaacacttcggaagggacactcctgggcaaatgaaaacatggatgaaggggtccgtggggaaccttttgatgattcaaggcctaatactgcctcaacgactggttctatggcttccaatgatcaagaagacgaaacaatgtcgattggtggcatagcaatgagttctcaaacaatcacaattggtgtttcggaaattttaaacctccttaggacactcggagaagggtgtagactttcatacatgtacaggtgtcaggaggcactggatacgtatatgaaacttccacataagcattataatacaggatgggttctttcccaggtcgggaaagcatactttgaactaattgactatttagaggctgaaaaggcattccgtcttgcccgtctggcttctccttattgcttagaaggaatggatatatactctacggtcctctatcatttgaaggaagacatgaagctgagttacttggctcaggaactaatatcaaccgatcgcttagctcctcaatcttggtgtgctatgggaaattgctatagcttgcaaaaggaccatgagaccgcactgaagaatttcctacgagctgttcaactgaatccaagatttgcatatgcacataccttatgtggccacgaatacacaactcttgaggattttgagaacggaatgaaaagttaccaaaacgcacttcgtgtagatacaagacactacaacgcatggtacgggcttggaatgatatatctacgccaagagaagttagagttctcagagcatcacttcagaatggctttcctaataaacccgagttcctctgttataatgtcttatttagggacatctttgcatgccttgaagagaagtgaggaagcactagagataatggagcaagccatagtagcagatagaaaaaaccctcttccaatgtaccagaaagctaacatacttgtctgcttagaaagattagatgaagctctagaagttcttgaggagctcaaagagtatgcgccttcagagagcagcgtttacgctttaatgggcaggatctataagcggcgaaacatgcacgataaagccatgcttcatttcggtctagctttagatatgaaaccgcctgcaactgacgttgctgcaataaaggctgcaatggagaaattgcatgttccagatgagatcgatgagagcccgtga

SEQ ID NO: 132 - protein, 744 aa, Arabidopsis thaliana
MEAMLVDCVNNSLRHFVYKNAIFMCERLCAEFPSEVNLQLLATSYLQNNQAYSAYHLLKGTQMAQSRYLFALSCFQMDLLNEAESALCPVNEPGAEIPNGAAGHYLLGLIYKYTDRRKNAAQQFKQSLTIDPLLWAAYEELCILGAAEEATAVFGETAALSIQKQYMQQLSTSLGLNTYNEERNSTSTKNTSSEDYSPRQSKHTQSHGLKDISGNFHSHGVNGGVSNMSFYNTPSPVAAQLSGIAPPPLFRNFQPAVANPNSLITDSSPKSTVNSTLQAPRRKFVDEGKLRKISGRLFSDSGPRRSSRLSADSGANINSSVATVSGNVNNASKYLGGSKLSSLALRSVTLRKGHSWANENMDEGVRGEPFDDSRPNTASTTGSMASNDQEDETMSIGGIAMSSQTITIGVSEILNLLRTLGEGCRLSYMYRCQEALDTYMKLPHKHYNTGWVLSQVGKAYFELIDYLEAEKAFRLARLASPYCLEGMDIYSTVLYHLKEDMKLSYLAQELISTDRLAPQSWCAMGNCYSLQKDHETALKNFLRAVQLNPRFAYAHTLCGHEYTTLEDFENGMKSYQNALRVDTRHYNAWYGLGMIYLRQEKLEFSEHHFRMAFLINPSSSVIMSYLGTSLHALKRSEEALEIMEQAIVADRKNPLPMYQKANILVCLERLDEALEVLEELKEYAPSESSVYALMGRIYKRRNMHDKAMLHFGLALDMKPPATDVAAIKAAMEKLHVPDEIDESP

SEQ ID NO: 133 - DNA, 2181 bp, Arabidopsis thaliana
atgatggagaatctactggcgaattgtgtccagaaaaaccttaaccattttatgttcaccaatgctatcttcctttgcgaacttcttctcgcccaatttccatctgaggtgaacctgcaattgttagccaggtgttacttgagtaacagtcaagcttatagtgcatattatatccttaaaggttcaaaaacgcctcagtctcggtatttatttgcattctcatgctttaagttggatcttcttggagaggctgaagctgcattgttgccctgtgaagattatgctgaagaagttcctggtggtgcagctgggcattatcttcttggtcttatatatagatattctgggaggaagaactgttcaatacaacagtttaggatggcattgtcatttgatccattgtgttgggaagcatatggagaactttgtagtttaggtgccgctgaagaagcctcaacagttttcgggaatgttgcttcccagcgtcttaaaacttgtgtagaacaaagaataagcttctcagaaggagcaaccatagaccagattacagattctgataaggccttaaaagatacaggtttatcgcaaacagaacacattccaggagagaaccaacaagatctgaaaattatgcagcagcctggagatattccaccaaatactgacaggcaacttagtacaaacggatgggacttgaacacaccttctccagtgcttttacaggtaatggatgctccaccgcctctgcttcttaagaatatgcgtcgtccagcagtggaaggatctttgatgtctgtacatggagtgcgtgtgcgtcgaagaaacttttttagtgaagaattgtcagcagaggctcaagaagaatctgggcgccgccgtagtgctagaatagcagcaaggaaaaagaatcctatgtcgcagtcatttggaaaagattcccattggttacatctttcaccttccgagtcaaactatgcaccttctctttcctcgatgattggaaaatgcagaatccaaagcagcaaagaagcgattcctgataccgttactctaaatgatccagcaacgacgtcaggccagtctgtaagtgacactggaagctctgttgatgatgaggaaaagtcaaatcctagtgaatcttccccggatcgtttcagccttatttctggaatttcagaagtgctaggcattctgaaaattcttggagatggccacaggcatttacatatgtacaagtgtcaggaagctttgttggcatatcaaaagctatctcagaaacaatacaatacacactgggttctcatgcaggttggaaaagcatattttgagctacaagactacttcaacgctgactcttcctttactcttgctcatcaaaagtatccttatgctttggaaggaatggatacatactccactgttctttatcacctgaaagaagagatgaggttgggctatctggctcaggaactgatttcagttgatcgcctgtctccagaatcctggtgtgcagttgggaactgttacagtttgcgtaaggatcatgatactgctctcaaaatgtttcagagagctatccaactgaatgaaagattcacatatgcacataccctttgtggccacgagtttgccgcattggaagaattcgaggatgcagagagatgctaccggaaggctctgggcatagatacgagacactataatgcatggtacggtcttggaatgacctatcttcgtcaggagaaattcgagtttgcgcagcatcaatttcaactggctctccaaataaatccaagatcttcagtcatcatgtgttactatggaattgctttgcatgagtcaaagagaaacgatgaggcgttgatgatgatggagaaggctgtactcactgatgcaaagaatccgctccccaagtactacaaggctcacatattaaccagcctaggtgattatcacaaagcacagaaagttttagaagagctcaaagaatgtgctcctcaagaaagcagtgtccatgcatcgcttggcaaaatatacaatcagctaaagcaatacgacaaagccgtgttacatttcggcattgctttggatttaagcccttctccatctgatgctgtcaagataaaggcttacatggagaggttgatactaccagacgagctggtgacggaggaaaatttg

SEQ ID NO: 134 - protein, 728 aa, Arabidopsis thaliana
MMENLLANCVQKNLNHFMFTNAIFLCELLLAQFPSEVNLQLLARCYLSNSQAYSAYYILKGSKTPQSRYLFAFSCFKLDLLGEAEAALLPCEDYAEEVPGGAAGHYLLGLIYRYSGRKNCSIQQFRMALSFDPLCWEAYGELCSLGAAEEASTVFGNVASQRLQKTCVEQRISFSEGATIDQITDSDKALKDTGLSQTEHIPGENQQDLKIMQQPGDIPPNTDRQLSTNGWDLNTPSPVLLQVMDALPPLLLKNMRRPAVEGSLMSVHGVRVRRRNFFSEELSAEAQEESGRRRSARIAARKKNPMSQSFGKDSHWLHLSPSESNYAPSLSSMIGKCRIQSSKEVIPDTVTLNDPATTSGQSVSDIGSSVDDEEKSNPSESSPDRFSLISGISEVLSLLKILGDGHRHLHMYKCQEALLAYQKLSQKQYNTHWVLMQVGKAYFELQDYFNADSSFTLAHQKYPYALEGMDTYSTVLYHLKEEMRLGYLAQELISVDRLSPESWCAVGNCYSLRKDHDTALKMFQRAIQLNERFTYAHTLCGHEFAALEEFEDAERCYRKALGIDTRHYNAWYGLGMTYLRQEKFEFAQHQFQLALQINPRSSVIMCYYGIALHESKRNDEALMMMEKAVLTDAKNPLPKYYKAHILTSLGDYHKAQKVLEELKECAPQESSVHASLGKIYNQLKQYDKAVLHFGIALDLSPSPSDAVKIKAYMERLILPDELVTEENL

SEQ ID NO: 135 - DNA, 1835 bp, Oryza sativa
  misc_feature (729)..(732): n is a, c, g, or t
atggaaaccctaatggtggaccgcgtccacggcagcctccgcctcttcatgcaccgcaacgccgtcttcctctgcgagcgcctctgcgcccagttccccgccgagacaaatgtccagttgtagcaacttgctaccttcacaacaaccagccatatgctgcataccacatcttgaaaggaaagaagctgccagagtcccggtacttgtttgctatgtcatgcttccgaatgaacctcttacgggaagctgaagaagccttgtgtcctgtcaatgaaccaaatattgaggttccaagtggtgcaacagggcactaccttcttggagtaatttacaggtacactggcagagtggaagctgcagctgagcaatttgtacaagctctgactcttgatcctcttctatgggcagcatacgaggaattgtgcatactaggtgttgctgaagatgcaaatgaatgtttcagtgaagcaacagctctacgtcttcagcaggaactcacatccacatcaaatgtggaaaagtcaaactttgttaatgaaaatcggtttctatcttccaatgtgtcagcaagttttggtgatagtcctaagcaaattaaacagctgcatgctaacaccactgcagaagtatctggttatcctcatgtaaagtcaactgcattgcatatgcagaacggtgcaccatctaatttatcacagtttgacactccatcgccaacttcaacgcagnnnnataatgtaacttcaacttcgtcttctacaagtatagttgatggaagatatcccgagcaagagaaatctgaacgagttctgtcacaggactccaaattagctattggtatcagggagctaatggcactcttgcggacactaggggaagggtataggctttcttgcttgtttaagtgtcaggaagcattggaagtatatagaaagctcccagaggcacaatttaatactggatgggttctttgccaggttgggaagacatattttgaactcgtcaattatttagaagccgatcatttttttgagttagcgcatcgactatcaccatgcacgttggagggaatggacatttactccactgttctttatcatttgaatgaggaaatgcggctaagttaccttgctcaagatcttgtttctattgatcgactatctccccaagcatggtgtgctgtgggaaattgctttgccttgaggaaagatcatgagactgccttgaagaattttcaacgtgctgtacagcttgactcaagagttgcatacgctcacacgctatgcggtcacgatataaaactataccgatctgcacttcaggtagatgaaagacactacaatgcctggtatggccttggagtggtgtaccttcgccaggaaaagtttgagtttgctgagcatcatttcagaagggcattccagataaatccttgctcttctgttcttatgtgctatcttgggatggccttgcatgctttaaagaggaatgaggaagccttggaaatgatggagaaggctatatttgctgataagaagaatccactccccaagtatcaaaaggctttaatccttctaggcctacaaaaataccctgatgctctggatgagttggaacggctaaaggaaattgcacctcatgaaagtagtatgtatgcactgatgggaaagatttacaagcaacttaacattcttgacaaggctgtattttgctttggcattgccctggatttgaaacctcctgctgctgacgttgctataatacaatctgcaatggagaaagtacaccttccagatgaacttatggatgatgatgatgatgatgatgagatttaa

SEQ ID NO: 136 - protein, 757 aa, Oryza sativa
METLMVDRVHGSLRLFMHRNAVFLCERLCAQFPAEVNVQLLATCYLHNNQPYAAYHILKGKKLPESRYLFAMSCFRMNLLREAEEALCPVNEPNIEVPSGATGHYLLGVIYRYTGRVEAAAEQFVQALTLDPLLWAAYEELCILGVAEDANECFSEATALRLQQELTSTSNVEKSNFVNENRFLSSNVSASFGDSPKQIKQLHANTTAEVSGYPHVKSTALHMQNGAPSNLSQFDTPSPTSTQVSGIAPPPLFRNMHAYQNTAGGNAPSKPKVNAPNLTLRRKYIDEAGLKKVSGRLFNQSSDSVPRRSARLSRDTTINSNSNISQFGGNGTDHSSGKLRVNSSTPSKLCSTALRSVQVRKGKPQATENFDEGDYHFDMDDSVTSTSSSTSIVDGRYPEQEKSERVLSQDSKLAIGIRELMALLRTLGEGYRLSCLFKCQEALEVYRKLPEAQFNTGWVLCQVGKTYFELVNYLEADHFFELAHRLSPCTLEGMDIYSTVLYHLNEEMRLSYLAQDLVSIDRLSPQAWCAVGNCFALRKDHETALKNFQRAVQLDSRVAYAHTLCGHEYSALEDYENSIKLYRSALQVDERHYNAWYGLGVVYLRQEKFEFAEHHFRRAFQINPCSSVLMCYLGMALHALKRNEEALEMMENAIFADKKNPLPKYQKALILLGLQKYPDALDELERLKEIAPHESSMYALMGKIYKQLNILDKAVFCFGIALDLKPPAADVAIIKSAMEKVHLPDELMDDDDDDDEI

SEQ ID NO: 137 - DNA, 2253 bp, Solanum tuberosum
atggaaaccctactagctgaatctgtgcaaaacagccttggccaatttatgtaccacaacgccattttcatgtgtgaacgactctgtgccgagttccccactgagacaaatatgcagcttttagctggctgctacctgcacaaccaacaggcttatgctgcatatcatcttctcaaggggacaagtatggctcaatcccgctacttgtttgcactatcatgctttcagatggatcttctcactgaagctgagacagcactttgccctcctaatgagccaactgcagaggttccaaatggtgcagctgggcattaccttcttggtcttatttacaggtatacagatagaagaaatagttccatccagcatttcaatcaggcattgttattggatccattgctatgggctgcatatgaggagttgtgtatactaggtgctgcagaagaagcagctgcagtttttggggaagcatctttgctttgcattcagaaacaacacatagaccaagggaaccaatctcaaaatttacaagcatccactgatgatcagaatgtagcttctacgaatattgtctcaggcgacatcagccctatgcaatcaaaacatacacacagccataatcttcgagaaatgtctggaaattataatggagcagctgctatccagaatttaggtggggtttctactaacatgtcattctacaacactccctcaccaatggcatcacagttgtcaggagtggttccacctccagtttgtagaaattttcagcaaaatggaactaatgcatctgtggctggtgctgataattctccacgagcaactgtcaattcaaccattcaggcccctcggagaaagtttgttgatgaggggaagttaagaaagatatctgggaggttattttctgattctggccctcgacgaaattcaaggcttgctggagaatctactggaaacacaaattcaaatgtatctggtgcttctggaaatggaacaattcattcttccaaatattatggtagttcgaagctgagctcaatgactttacgttccatgacaagtcgaaaggcacaatcttgggctaccgaaaactatggtgaagggactcgcaatgacatttctaatgattctcggctaaatatgactatgtcacacccttctggagatgctagacctcttgaacaagaaaggccccgaacttctgcttctggggttaatgtaagcagcacatctatccctctcagtgcttcagagatattggcccttttcaggtttcttggggaaggctatagactttcttgtttatatagatgtcaggatgcactggatgtttataacaaactcccacacaaacattatcacactggatgggttctttctcagattggaagagcatacttcgaaatggttgattacctagaagcagatcatgcatttggccttgctcgtctggcctcaccttatagtttagaaggaatggacgtgtactcgacagtgttgtttcatctcaaggaggacatgaagttgagctatctggcgcaggtgctggtatcaactgatagattagctcctcaatcttggtgtgctatggggaattgctatagtttacagaaagaccatgaaactgctcttaaaaattttcaacgagctgtacaactaaatcctagatttgcatacgggcacacgctttgtggtcatgaatatgttgctttagaagattttgaaaatgctattaagagctatcagagtgcacttcgtgtggatgccaggcattacaatgcctggtatgggcttggaatgatctatctccgacaggagaagtttgaattttcagagcatcactttcgaatggctttgggtataaatccacagtcttctgttatcatgtcatatcttggcactgcattacacgctctgaagaaaaatgaagaggcattggaagtgatggagctggctattgtagcagacaagaaaaaccctcttccaatgtatcagaaggctaacatccttgtgagcacggaaagttttgatgccgctttagaagtcttagaggaacttaaagagcatgctcctcgtgagagcagtgtctatgctttgatgggtcggatatacaagaggcgtaatatgtacgacaaagccatgcttcattttggagtggcattagatttaaaaccatctgcaactgatgttgctaccattaaggctgccattgaaaagctgcatgtaccagatgagatggaagatgaattataa

SEQ ID NO: 138 - protein, 750 aa, Solanum tuberosum
METLLAESVQNSLGQFMYHNAIFMCERLCAEFPTETNMQLLAGCYLHNQQAYAAYHLLKGTSMAQSRYLFALSCFQMDLLTEAETALCPPNEPTAEVPNGAAGHYLLGLIYRYTDRRNSSIQHFNQALLLDPLLWAAYEELCILGAAEEAAAVFGEASLLCIQKQHIDQGNQSQNLQASTDDQNVASTNIVSGDISPMQSKHTHSHNLREMSGNYNGAAAIQNLGGVSTNMSFYNTPSPMASQLSGVVPPPVCRNFQQNGTNASVAGADNSPRATVNSTIQAPRRKFVDEGKLRKISGRLFSDSGPRRNSRLAGESTGNTNSNVSGASGNGTIHSSKYYGSSKLSSMTLRSMTSRKAQSWATENYGEGTRNDISNDSRLNMTMSHPSGDARPLEQERPRTSASGVNVSSTSIPLSASEILALFRFLGEGYRLSCLYRCQDALDVYNKLPHKHYHTGWVLSQIGRAYFEMVDYLEADHAFGLARLASPYSLEGMDVYSTVLFHLKEDMKLSYLAQVLVSTDRLAPQSWCAMGNCYSLQKDHETALKNFQRAVQLNPRFAYGHTLCGHEYVALEDFENAIKSYQSALRVDARHYNAWYGLGMIYLRQEKFEFSEHHFRMALGINPQSSVIMSYLGTALHALKKNEEALEVMELAIVADKKNPLPMYQKANILVSTESFDAALEVLEELKEHAPRESSVYALMGRIYKRRNMYDKAMLHFGVALDLKPSATDVATIKAAIEKLHVPDEMEDEL

SEQ ID NO: 139 - DNA, 1998 bp, Schizosaccharomyces pombe
atgacagatcgattgaaatgtttaatatggtattgcattgataatcagaattatgataattcaattttttattcagaacgtttacatgcaattgaagattcaaacgagagtttgtatcttttggcatattcgcatttcctaaacctcgattacaatattgtatacgacttattagatagagtaattagtcatgttccttgcacatacttatttgcaaggaccagccttattttaggcagatataaacaaggaataagtgctgtggaggcctgtcgatcgaattggcgctccattcagccaaacataaatgactcaattagcagtcgtggacatccagatgcctcttgcatgcttgatgttttgggtactatgtataaaaaggcagggttcctcaaaaaagctacagattgttttgtagaagctgtctccattaacccatataatttctctgctttccagaatttaactgcaataggcgtgccactcgatgctaataatgtatttgttattccaccctaccttacggcaatgaagggttttgaaaaatctcaaacgaatgctacagcttcggtaccagaaccgtcttttttgaagaaaagtaaagagtcttcctcatcttccaacaagttttcggtttctgaatcgatagcaaatagttattcaaactcatccatttcagcatttactaagtggtttgatagggttgacgcttctgagcttccaggaagtgagaaggaacgacatcaaagcttgaaattacaatctcaatctcagactagcaaaaaccttttggctttcaatgatgctcaaaaagctgattctaacaatagggatacgtctttaaaatcccactttgtggaacctagaacccaagcattaagaccaggagctcgtttaacatataaattacgcgaagcgagaagttctaaaagaggagagagcacacctcaaagcttccgcgaagaggacaataatttgatggaattactaaagttattcggtaagggtgtttacctgctcgcccagtataagttacgagaggctttaaattgtttccaaagcttgcccatcgaacagcaaaatacaccttttgttcttgcaaagcttggaataacctactttgaactggttgattacgaaaaatctgaagaagtgtttcaaaaattaagggacttgtcgccttcacgtgtcaaagatatggaagtcttttcaactgcactttggcatttgcaaaagtctgttcctttatcttaccttgcccatgaaactttggaaactaatccttattccccagaatcatggtgcattcttgctaattgcttctcacttcaacgtgaacactcgcaggcattaaaatgtattaatagagctattcaattggatccaacttttgaatatgcttatacgcttcaagggcacgagcattctgcaaacgaagaatacgaaaaatcgaaaacatctttccgcaaagcaattagagtaaatgttcgacattacaatgcatggtatggcctgggaatggtttatttaaaaacagggcgaaatgatcaagcagactttcattttcaacgtgctgcagagatcaatcctaacaactctgtactcatcacttgtattggtatgatttacgaacgctgcaaagattacaaaaaagcacttgatttttatgatcgggcatgtaaactggatgaaaagtcttcgcttgccaggttcaagaaagccaaagtgcttattttattacatgatcacgataaagcactcgttgaattggaacaattaaaggcaattgcgccagatgaagcaaatgttcattttttgctcggcaaaattttcaagcaaatgcggaaaaaaaatttagccttaaagcacttcactatagcatggaacttagacggcaaggctacgcatattattaaggaatcgattgaaaatctggatattcccgaagaaaatttgttaactgaaacaggtgaaatttataggaatctggaaacttaa

SEQ ID NO: 140 - protein, 665 aa, Schizosaccharomyces pombe
MTDRLKCLIWYCIDNQNYDNSIFYSERLHAIEDSNESLYLLAYSHFLNLDYNIVYDLLDRVISHVPCTYLFARTSLILGRYKQGISAVEACRSNWRSIQPNINDSISSRGHPDASCMLDVLGTMYKKAGFLKKATDCFVEAVSINPYNFSAFQNLTAIGVPLDANNVFVIPPYLTAMKGFEKSQTNATASVPEPSFLKKSKESSSSSNKFSVSESIANSYSNSSISAFTKWFDRVDASELPGSEKERHQSLKLQSQSQTSKNLLAFNDAQKADSNNRDTSLKSHFVEPRTQALRPGARLTYKLREARSSKRGESTPQSFREEDNNLMELLKLFGKGVYLLAQYKLREALNCFQSLPIEQQNTPFVLAKLGITYFELVDYEKSEEVFQKLRDLSPSRVKDMEVFSTALWHLQKSVPLSYLAHETLETNPYSPESWCILANCFSLQREHSQALKCINRAIQLDPTFEYAYTLQGHEHSANEEYEKSKTSFRKAIRVNVRHYNAWYGLGMVYLKTGRNDQADFHFQRAAEINPNNSVLITCIGMIYERCKDYKKALDFYDRACKLDEKSSLARFKKAKVLILLHDHDKALVELEQLKAIAPDEANVHFLLGKIFKQMRKKNLALKHFTIAWNLDGKATHIIKESIENLDIPEENLLTETGEIYRNLET

SEQ ID NO: 141 - DNA, 2421 bp, Aspergillus niger
atgactccgtccacatcacatatttcgagccagctaaggcagctgatatattaccatcttgacaacaaccttgctcggaacgcgctgttccttgccggtcgtttacacgcctacgaacctcggacgtcggaagcttcgtacctattagctctgtgttacctacaaaatggtcaggtgaaagcagcatgggaaactagcaagcattttgggtcgaggggtgcgcatcttggatgttcttacgtctacgcgcaggcttgtcttgacctcgggaaatatacggacggtattaacgcgctagagcgaagtaagggacaatggacttcgcgaaaccactggaataaacacagtgagacgcgacgacaacacttgccggatgctgcggcagttttatgtttgcaaggaaaattatggcaggcacacaaggaacacaacaaggctgtggagtgttacgctgcagctttaaagctgaatcccttcatgtgggatgcattcttgaatctgtgcgaaactggtgttgatttgcgtgtttcaaacatatataagatgagcccggaattgtacagcatggtatcgtctgctgcgctcgaagatgttgaatcccaggttctacctccggacggtccactccagacacaagttaacccaaatccgagcttggacccgttcactgccggtacgactcgcagcgattcgacctctactcacgggagctcagctttgtgggaaaagttgaatggaagcacagttagtgtggcatcttcaggaacaggaccgcatcttccgcgggaaggcatggagactcctggtggccaaagtagcgaatctgatgatccacgtgtaaccaacggtaatggcacagatgtttttgagccgccgctagcccctgcaaagaagaatcgaacgatccaaacaataggcggcgatcatccgatggatcccccgccaaagatgcggccaaccggtattcgaccgaggacccgaaccaaattcgagtcagatgaaggtcatactgagagagacgcgggcatgggtcacaggttaggcgatcggaaacgaacggtctctggacaagttgcgcatccgtcggtaccgcattcaaccgaccaaggtgtcgggcaacggcgaagtgtacgtctctttaaccagataaagccatcaacgaacaaaatatctagcacggcattaggagtgaaagagggccgggaggtgaaaaaggtgagaactacggggaataaggcgcgcacaacaacaagctcaaatgtgggccgtgttgttagcggcaacaatcgacgacacgctggggagatccatgacggagacagcaaagaataccgtggaacatcttcaacatcaaatggctctcagaacgcatcgtctaagctcgctatatctgagcggaccaaatcggttgaagccttggcttggattttggacttgtttttcaagatagcctccggctatttctgtctcagccggtacaaatgctccgatgctatccagattttcagctctctatcccagggccaacgggagacaccgtgggttcttgctcaaattggacgagcttactacgagcaagcaatgtatacagaggccgagaaatactttgtccgggtgaaggccatggcgccttcccggttagaagatatggagatctactcgacggttctttggcatttgaagaatgatgtcgaacttgcttacctggcccatgagttaatggatgtcgatcgcttatcaccagaagcttggtgtgctgtcggtaactcgttctcacaccagcgggaccacgatcaagctctgaagtgcttcaagcgtgccactcaattggatcctcatttcgcgtatgggttcacgctacagggccatgagtatgttgccaacgaggaatatgacaaggcattggatgcctatagaagcggcatcaacgcggacagtcgacattataatgcctggtacgggctgggaacggtctacgataagatgggcaaacttgactttgctgaacagcacttccgtaatgcggccaagattaatccttctaatgctgttttaatatgctgcattggcttggtcttagagaagatgaacaatccgaagtcagcgttgatccagtacaacagggcctgcaccctcgcgcctcattctgttcttgctcgattccgaaaagcccgtgcgttgatgaaattgcaggatctcaagtcagcgcttacggagctgaaggttctgaaggacatggcgccggatgaggcaaacgttcattacctcctgggcaaactgtataagatgcttcgtgacaagggaaatgccattaagcacttcacaactgcattaaaccttgatcccaaggcggcgcagtacatcaaagatgcaatggaagcccttgacgacgatgaagaggatgaagaagatatggcgtga

SEQ ID NO: 142 - protein, 806 aa, Aspergillus niger
MTPSTSHISSQLRQLIYYHLDNNLARNALFLAGRLHAYEPRTSEASYLLALCYLQNGQVKAAWETSKHFGSRGAHLGCSYVYAQACLDLGKYTDGINALERSKGQWTSRNHWNKHSETRRQHLPDAAAVLCLQGKLWQAHKEHNKAVECYAAALKLNPFMWDAFLNLCETGVDLRVSNIYKMSPELYSMVSSAALEDVESQVLPPDGPLQTQVNPNPSLDPFTAGTTRSDSTSTHGSSALWEKLNGSTVSVASSGTGPHLPREGMETPGGQSSESDDPRVTNGNGTDVFEPPLAPAKKNRTIQTIGGDHPMDPPPKMRPTGIRPRTRTKFESDEGHTERDAGMGHRLGDRKRTVSGQVAHPSVPHSTDQGVGQRRSVRLFNQIKPSTNKISSTALGVKEGREVKKVRTTGNKARTTTSSNVGRVVSGNNRRHAGEIHDGDSKEYRGTSSTSNGSQNASSKLAISERTKSVEALAWILDLFFKIASGYFCLSRYKCSDAIQIFSSLSQGQRETPWVLAQIGRAYYEQAMYTEAEKYFVRVKAMAPSRLEDMEIYSTVLWHLKNDVELAYLAHELMDVDRLSPEAWCAVGNSFSHQRDHDQALKCFKRATQLDPHFAYGFTLQGHEYVANEEYDKALDAYRSGINADSRHYNAWYGLGTVYDKMGKLDFAEQHFRNAAKINPSNAVLICCIGLVLEKMNNPKSALIQYNRACTLAPHSVLARFRKARALMKLQDLKSALTELKVLKDMAPDEANVHYLLGKLYKMLRDKGNAIKHFTTALNLDPKAAQYIKDAMEALDDDEEDEEDMA

SEQ ID NO: 143 - DNA, 2472 bp, Homo sapiens
atgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactacctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttcgaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaa

SEQ ID NO: 144 - protein, 824 aa, Homo sapiens
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 145 - DNA, 783 bp, Saccharum officinarum
  misc_feature (780)..(783): n is a, c, g, or t
atggaaaccctaatggtggaccgcgtccacagcagcctccgcctcttcatgcaccgcaacgccgtattcctctgcgagcgcctctgcgcgcagttcccctccgagaccaatgtgcaattgttagcgacctgctacctccacaacaatcagccatatgctgcataccacattttgaaagggaagaagctgccggagtcccggtacttgtttgctacatcatgctttcgaatgaacctcttgcgtgaagcagaagaaactctatgtccagtcaatgaaccaaacatggaggttccaagtggagcaacaggacactacctccttggagtgatttacaggtgcacaggcagaatttcagctgcagctgaacaatttacacaagcgttgactctagatcctcttttatgggcggcatatgaggaattgtgtatattaggtattgctgaagatactgatgagtgttttagtgaatcgactgctctacgtctccagcaggaacacacatccacggccactctggtgaagtcgaacttcgccaatgaaaatcgagttctatcatccagggtctctgcaaatcttggggatattagtcctaagcaaatcaaacagcttcatgctaacaacatagcagaagtatctggctatcctcatgtaagaccaactgcattgcatgtgcagaacagttcaacctctaatgtagcacagtttgacaccccatcaccaactgcagcacagacttctagtatcatgccaccaccactctttaggaatgtccatgcttannnn

SEQ ID NO: 146 - protein, 259 aa, Saccharum officinarum
METLMVDRVHSSLRLFMHRNAVFLCERLCAQFPSETNVQLLATCYLHNNQPYAAYHILKGKKLPESRYLFATSCFRMNLLREAEETLCPVNEPNMEVPSGATGHYLLGVIYRCTGRISAAAEQFTQALTLDPLLWAAYEELCILGIAEDTDECFSESTALRLQQEHTSTATLVKSNFANENRVLSSRVSANLGDISPKQIKQLHANNIAEVSGYPHVRPTALHVQNSSTSNVAQFDTPSPTAAQTSSIMPPPLFRNVHA

SEQ ID NO: 147 - DNA, 1314 bp, Saccharum officinarum
  misc_feature (416)..(416): n is a, c, g, or t
  misc_feature (881)..(881): n is a, c, g, or t
attcaaattcaaatacctggggtttggagggaatggtacaggttattcgtcagggaaattgcgagtaaactcgtccacaccatcaaaatggtgttaaccaccatacgttccgtgcaagttaggaaaggaaaaccacgggctacagaaaattttgatgaaggaagtagatatgaagtcattgatgaaatgtggacagacaatatatcaggaacttcatcttctgtaagtacagctgatggaagatcctttgagcaagataaagctgaacgaattctgttgcaagactccaaattggcacttggtattagggagatattgggacttgtccgaacactcggtgaaggttgtaggctttcttgcttgtttaagtgccatgaagccttggaagtctacagaagactccctgagacccattntagcactggatggagcatatgccaggttggtaaggcatatttcgaattagttgattatttggaagctgatcgttactttgaattggcacaccgactgtcgccttgtacgcttgatggaatggacatctattctactgttctttatcatctgaatgaggaaatgagactaagctaccttgctcaagagcttatttccattgatcgactatctcctcaagcatggtgtgcagtgggcaattgctttgccttgaggaaagatcatgagactgctttgaagaattttcaacgttcggtacagcttgactcaagatttgcatatgctcacactctatgtggtcatgagtattctgcattggaggattatgagaatagtatcaaattctaccggtgtgcactgcaggtagatgaaaggcactacaatgcctggtatggccttggggtggtgtatcttcgccaggaaaagtntgagtttgctgagcatcatttcagaagggcatttcagataaatcctcgctcttctgttctcatgtgctatcttgggatggcgttgcattctcttaagaggaaggaggaggcattggaaatgatggagaaagctatagcagctgataagaagaatccactgcccaagtatcagaaggccttaatccttctaggtcttcagaagtatcaagaagctctggatgagttggagcggctaaaggagattgcacctcatgagagcagtatgtatgcactgatgggaaagatttacaagcaactcaatatccttgacaaagctgttttctgctttggcattgccctggatttgaaacctcctgctgctgatcttgctataattaagtccgcaatggagaaagtacatctccctgatgaactgatggaggatgacctgtaa

SEQ ID NO: 148 - protein, 437 aa, Saccharum officinarum
  UNSURE (139)..(139): Xaa can be any naturally occurring amino acid
  UNSURE (294)..(294): Xaa can be any naturally occurring amino acid
IQIQIPGVWREWYRLFVREIASKLVHTIKMVLTTIRSVQVRKGKPRATENFDEGSRYEVIDEMWTDNISGTSSSVSTADGRSFEQDKAERILLQDSKLALGIREILGLVRTLGEGCRLSCLFKCHEALEVYRRLPETHXSTGWSICQVGKAYFELVDYLEADRYFELAHRLSPCTLDGMDIYSTVLYHLNEEMRLSYLAQELISIDRLSPQAWCAVGNCFALRKDHETALKNFQRSVQLDSRFAYAHTLCGHEYSALEDYENSIKFYRCALQVDERHYNAWYGLGVVYLRQEKXEFAEHHFRRAFQINPRSSVLMCYLGMALHSLKRKEEALEMMEKAIAADKKNPLPKYQKALILLGLQKYQEALDELERLKEIAPHESSMYALMGKIYKQLNILDKAVFCFGIALDLKPPAADLAIIKSAMEKVHLPDELMEDDL

SEQ ID NO: 149 - DNA, 54 bp, Artificial sequence
  primer: prm00778
ggggacaagtttgtacaaaaaagcaggcttcacaatgcaacaactgtcaacttc

SEQ ID NO: 150 - DNA, 49 bp, Artificial sequence
  primer: prm00779
ggggaccactttgtacaagaaagctgggttggagtagctatggtttcac

SEQ ID NO: 151 - DNA, 1042 bp, Oryza sativa
ggggagttaggaaccttgacatacaaccaatgataccattttttttcaagcagctagaggtacagaggttcatattttttagatggctcattagtgatattttagtcaaaaatttcagaagtacggccacgggtgatggcctgaactaatattttattcgaggtgccgctacatcatcgtctaaagtacacgcaagattcaacggaaaaaagaaaccgatcgatcgagatcagttagttaatgaaataactagatcaactcatgtcgtcaaaaacaaaagatgctcatctatggacaacacacgctgatgattcgatcatcaaacaaaggtggtagtagtagtaaagcgtatcgtgtttctcatcagaaagaagaattaaagaaaaaactaatcccgtctcgcgagccagagaaaattccctacaaaagccactcctttgatttgacatgcaaaagcaaggctccactcctctactaccctacaactacacaacactgtctctctatctccaaaggcagtagctgtattggcttccagcttttcctctctacctctaatgatagcttggagcaagttcaatagtatagctaactactagctctaattcatctataatcaatctaatagcttattcatacaatagttatatactacattattaatatctggtcccatctatcatacacactgagtctgtgctatagctgactacaaatctgtagcccgctgctcttctctcttcatttatcttcttaaaatatatttgcagctggcttatggcttatagcttgatattgagagggagaggagtgagagctagctcagctcagctcaaggtaaacaacaaggcacactcttcctacctcttctccggttcttcctttttcctctttctcttcgtccaagaacttcacctcaatagctcgagctacggcctaacttttgcgttgcgcaggagagctcgatcgctgcaccaatacttcactggagatcgcctagctgcagctagctagcttatcctgcgtgtcttgagcttctctc

SEQ ID NO: 152 - DNA, 951 bp, Oryza sativa
atggatccggtcacggcatcaatacacggtcaccatcttcctccaccgttcaacacccgcgacttccatcaccatctccagcagcagcagcaccagctgcatctcaagaccgaggatgaccaaggcggcggcactccgggtgtcttcggcagccgcggcaccaagcgcgaccacgacgacgacgagaacagtggcaacggccatggaagcggtggtgacggcggtgacctcgcgctggtacccccctcgggtggcgggccggacggcgccgggagcgagagcgccacgcgccgcccgaggggacgcccggcggggtccaagaacaagccgaagccaccgatcatcatcaccagggacagcgccaacacgctccggacgcatgtcatggaggtggccggcggctgcgacatctccgagagcatcaccacgttcgcgcgacgccggcagcgcggggtttgcgtgctcagcggcgccggcaccgtcactaacgtcacgctgcggcagcccgcatcgcagggagcggtcgttgcgctccacggccggttcgagatactctccctctccggctccttcctcccgccgcccgccccgccggaggccacggggctcaccgtctacctggccggaggccagggccaggtcgtgggcggcagcgtcgtcggcgcgctgaccgcggctgggcctgtggtgataatggcggcgtcttttgcgaacgcggtgtacgagcggctgccgttggaggacgacgagctactggcggctcaagggcaagccgacagcgctgggttgctcgccgcggggcagcaagcggcgcagctcgccggcggggccgtcgatccaagcctcttccaaggactaccaccaaacctactcggaaacgtgcagctgccgccggaagccgcctacggatggaaccctggcgccggcggtggccgcccggcgccgttctga

SEQ ID NO: 153 - protein, 316 aa, Oryza sativa
MDPVTASIHGHHLPPPFNTRDFHHHLQQQQHQLHLKTEDDQGGGTPGVFGSRGTKRDHDDDENSGNGHGSGGDGGDLALVPPSGGGPDGAGSESATRRPRGRPAGSKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEDDELLAAQGQADSAGLLAAGQQAAQLAGGAVDPSLFQGLPPNLLGNVQLPPEAAYGWNPGAGGGRPAPF

SEQ ID NO: 154 - DNA, 918 bp, Oryza sativa
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggccctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 155 - protein, 305 aa, Oryza sativa
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 156 - DNA, 906 bp, Lotus corniculatus
atggatccattatcagcacacggccactctcttcctcctccttttctccatctgcaccaccaacaccaacaccagcagcagcatcagcagcatcagttccactctttacagcagcagcaaaccccagcagaagatgaacagagtggaagcagcggcggcatcaaaagggaacgcgatgaaaacaacaacagccatgacggcaaagaaggctccggaggcggaggcgaaagcgagaattcaagaagacctcgaggaaggcccgccggatcgaagaacaagcctaagccgcccatcatcatcacccgcgacagcgccaacgcacttaagacccacgtcatggaggtcgccgacggctgcgacatcgtcgacagcgtctccaactttgcaagacgccgccagcgcggcgtctgcatcatgagcggcactggaaccgtcaccaacgtcactctcaggcagccagcttcttccggcgctgttgtcaccctccacggaaggtttgagattctctccctggcaggatcgttcctgccgccgcctgctccaccggcagcatcaggtttgaccatttacttggctggtggacaagggcaggttgttggaggaagtgttgtgggagctctcattgcttcgggacctgtggttatcatggcagcttcgttcagcaacgctgcgtatgagaggcttcctttggaagatgaggacccttcattggcaatgcaaggaggttcaatgggttcaccacccggtggtagtggtggtggtggtggagttggtcagcaacagcagcaacagcttttaggggatgcaactgccccactttttcatggtttgcctccgaatcttctcaattctgttcagatgccaaactccgataacttctggccatctggccgctctccttactga

SEQ ID NO: 157 - protein, 301 aa, Lotus corniculatus
MDPLSAHGHSLPPPFLHLHHQHQHQQQHQQHQFHSLQQQQTPAEDEQSGSSGGIKRERDENNNSHDGKEGSGGGGESENSRRPRGRPAGSKNKPKPPIIITRDSANALKTHVMEVADGCDIVDSVSNFARRRQRGVCIMSGTGTVTNVTLRQPASSGAVVTLHGRFEILSLAGSFLPPPAPPAASGLTIYLAGGQGQVVGGSVVGALIASGPVVIMAASFSNAAYERLPLEDEDPSLAMQGGSMGSPPGGSGGGGGVGQQQQQQLLGDATAPLFHGLPPNLLNSVQMPNSDNFWPSGRSPY

SEQ ID NO: 158 - DNA, 1020 bp, Arabidopsis thaliana
atggatccagttcaatctcatggatcacaaagctctcttcctcctcctttccatgctagagatttccaattacatcttcaacaacaacaacaacatcaacaacaacatcaacaacaacaacaacaacagttctttctccaccatcatcagcaaccacaaagaaaccttgatcaagatcacgagcagcaaggagggtcaatattgaatagatctatcaagatggatcgcgaagagacaagcgataacatggacaacatcgctaataccaacagcggtagcgaaggtaaagagatgagtttacacggaggagaaggaggaagcggtggtggaggaagtggagaacagatgacaagaaggccaagaggaagaccagcaggatccaagaacaaacctaaagctccaataatcataacaagagacagcgcaaacgcgcttcgaactcacgtcatggagataggagacggatgtgacatagttgactgtatggctacgttcgctagacgccgccaaagaggcgtttgcgttatgagcggtacaggaagcgttactaacgtcactatacgtcagcctggatcgccacctggctcggtggttagccttcacggccggtttgaaatcctctctctttcgggatctttcttgcctccgcctgcgccgcctgcagccaccggactaagcgtttacctagccggaggacaagggcaggtcgttggaggtagtgtggtgggacctttgttgtgttcgggtcctgtggtggttatggcggcttcttttagcaatgcggcgtacgaaaggctgcctttggaagaagatgagatgcagacgccagttcaaggaggcggtggaggaggaggaggtggtggtggaatgggatctcccccgatgatgggacagcaacaagctatggcagctatggcggcggctcaaggactaccaccgaatcttcttggttcggttcagttgccaccgccacaacagaatgatcagcagtattggtctacgggtcggccaccgtattga

SEQ ID NO: 159 - protein, 339 aa, Arabidopsis thaliana
MDPVQSHGSQSSLPPPFHARDFQLHLQQQQQHQQQHQQQQQQQFFLHHHQQPQRNLDQDHEQQGGSILNRSIKMDREETSDNMDNIANTNSGSEGKEMSLHGGEGGSGGGGSGEQMTRRPRGRPAGSKNKPKAPIIITRDSANALRTHVMEIGDGCDIVDCMATFARRRQRGVCVMSGTGSVTNVTIRQPGSPPGSVVSLHGRFEILSLSGSFLPPPAPPAATGLSVYLAGGQGQVVGGSVVGPLLCSGPVVVMAASFSNAAYERLPLEEDEMQTPVQGGGGGGGGGGGMGSPPMMGQQQAMAAMAAAQGLPPNLLGSVQLPPPQQNDQQYWSTGRPPY

SEQ ID NO: 160 - DNA, 975 bp, Arabidopsis thaliana
atggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattga

SEQ ID NO: 161 - protein, 324 aa, Arabidopsis thaliana
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 162 - DNA, 954 bp, Arabidopsis thaliana
atggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaa

SEQ ID NO: 163 - protein, 317 aa, Arabidopsis thaliana
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 164 - DNA, 798 bp, Arabidopsis thaliana
atggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaa

SEQ ID NO: 165 - protein, 265 aa, Arabidopsis thaliana
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 166 - DNA, 933 bp, Arabidopsis thaliana
atggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattga

SEQ ID NO: 167 - protein, 310 aa, Arabidopsis thaliana
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 168 - DNA, 987 bp, Oryza sativa
atggatccggtgacggcggcggcggcgcatgggggtgggcaccaccaccaccaccacttcggagcgccaccggtggcggcgttccaccaccacccgttccaccacggcggcggggcgcactacccggcggcgttccagcagtttcaggaggagcagcagcagcttgtggcggcggcggcggcggctggtgggatggcgaagcaggagctggtggatgagagcaacaacaccatcaacagcggcgggagcaacgggagcggcggggaggagcagaggcagcagtccggggaggagcagcaccagcaaggggcggcggcgccggtggtgatccggcgtcccaggggccgccccgccggctccaagaacaagcccaagcctccggtcatcatcacgcgcgacagcgccagcgcgctgcgggcgcacgtcctcgaggtcgcctccgggtgcgacctcgtcgacagcgtcgccacgttcgcgcgccgccgccaggtcggtgtctgcgtgctcagcgccaccggcgccgtcaccaacgtctccgtccggcagcccggcgcgggccccggcgccgtcgtcaacctcaccggccgcttcgacatcctctcgctgtccggctccttcctcccgccgccggcgcctccctccgccaccggcctcaccgtctacgtctccggcggccaggggcaggtcgtgggcggcacggtcgccggaccgctcatcgccgtcggccccgtcgtcatcatggccgcctcgttcgggaacgccgcctacgagcgcctcccgctcgaggacgacgagccgccgcagcacatggcgggcggcggccagtcctcgccgccgccgccgccgctgccattaccaccacaccagcagccgattcttcaagaccatctgccacacaacctgatgaacggaatccacctccccggcgacgccgcctacggctggaccagcggcggcggcggcggcggccgcgcggcgccgtactga

SEQ ID NO: 169 - protein, 328 aa, Oryza sativa
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTSGGGGGGRAAPY

SEQ ID NO: 170 - DNA, 777 bp, Oryza sativa
atggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctag

SEQ ID NO: 171 - protein, 258 aa, Oryza sativa
MGSIDGHSLQQHQGYSHGGGAGGSNEEEEASPPPGGGSATGSAGRRPRGRPPGSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLDQEGEEGAVLSGSEGAAAQMEQQSSGGAVVPPPMYAAVQQTPPHDMFGQWGHAAVARPPPTSF

SEQ ID NO: 172 - DNA, 798 bp, Lycopersicon esculentum
atggctggtttggacttaggttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatccggatctttcctaccaccacccgctccccctggggccaccagcttaacgatttatttagcgggtggtcaaggtcaagttgttggtggaaacgttgtgggtgcgctaattgcatcaggaccggttattgttattgcttcgtcatttactaatgttgcttatgagagattgcctttggatgaagaaaatgagtcaattcagatgcagcaacaaggacaaagtggtaattttgctgatccatctaatattggattaccttttcttaatttgccattaaacatgccaaatggtggtggtcaactacaattggaaagtggaggaggtgaaggttggaatggaaacacaacaaacaggccacaatattag

SEQ ID NO: 173 - protein, 265 aa, Lycopersicon esculentum
MAGLDLGSASHHRFLPRHLHDPQDDEINRNNTQFSDDDNNNNDNNNNNSPGVARRPRGRPAGSKNKPKPPVIITRESANALRAHILEVSSGHDVFESVATYARKRQRGICILSGSGTVNNVTIRQPQAAGSVVTLHGRFEILSLSGSFLPPPAPPGATSLTIYLAGGQGQVVGGNVVGALIASGPVIVIASSFTNVAYERLPLDEENESIQMQQQGQSGNFADPSNIGLPFLNLPLNMPNGGGQLQLESGGGEGWNGNTTNRPQY

SEQ ID NO: 174 - DNA, 813 bp, Arabidopsis thaliana
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttag

SEQ ID NO: 175 - protein, 270 aa, Arabidopsis thaliana
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 176 - DNA, 948 bp, Arabidopsis thaliana
atggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaa

SEQ ID NO: 177 - protein, 315 aa, Arabidopsis thaliana
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 178 - DNA, 708 bp, Oryza sativa
atggcgtccaaggagccaagcggcgaccacgaccacgagatgaacgggaccagcgccgggggcggcgagcccaaggacggcgcggtggtgaccggccgcaaccggcgcccccgcggacggccgccgggctccaagaacaagcccaagccgcccatcttcgtgacgcgggacagcccgaacgcgctgcgcagccacgtcatggaggtggccggcggcgccgatgtcgccgagtccatcgcgcacttcgcgcggcggcggcagcgcggcgtctgcgtgctcagcggggccggcaccgtgaccgacgtggccctgcgccagccggccgcgccgagcgccgtggtggcgctccgtgggcggttcgagatcctgtccctgacggggacgttcctgccggggccggcgccgccgggctccaccgggctgaccgtgtacctcgccggcgggcaggggcaggtggtgggcggcagcgtggtggggacgctcaccgcggcggggccggtcatggtgatcgcctccaccttcgccaacgccacctacgagaggctgccgctggatcaggaggaggaggaagcagcggcaggcggcatgatggcgccgccgccactcatggccggcgccgccgatccactacttttcggcgggggaatgcacgacgccgggcttgctgcatggcaccatgcccgccctccgccgccgccgccctactag

SEQ ID NO: 179 - protein, 235 aa, Oryza sativa
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 180 - DNA, 846 bp, Arabidopsis thaliana
atggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactga

SEQ ID NO: 181 - protein, 281 aa, Arabidopsis thaliana
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 182 - DNA, 879 bp, Arabidopsis thaliana
atggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctga

SEQ ID NO: 183 - protein, 292 aa, Arabidopsis thaliana
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 184 - DNA, 918 bp, Oryza sativa
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 185 - protein, 305 aa, Oryza sativa; identical to SEQ ID NO: 155

SEQ ID NO: 186 - DNA, 858 bp, Arabidopsis thaliana
atggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttag

SEQ ID NO: 187 - protein, 285 aa, Arabidopsis thaliana
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 188 - DNA, 978 bp, Medicago truncatula
atggatcaagtagcacaaggtcgtcctcttccacctccatttctcactagagaccttcatcttcatcctcaccatcaatttcacaccaaccaccaaaccaatgaagaggaacaacaaagtggcaatgggagcttaagccgaggccaaaaaagagaacgaaacaacgaagacggcaacaacactcccaccggaggagaaggaaaagacgacggtggtagcggaagtgctggtggaggaagtggtggtgagatgggaagaagaccaagaggaagaccagcaggttcgaaaaacaaaccaaaaccacctatcatcatcacgagggacagcgcgaacgcactccgatcccacgtgatggaagttgcaaatggatgtgacatcatggaaagtgtgacggtctttgcgcgaaggaggcagcgtggtgtctgcatccttagcggaagtgggaccgtcacaaacgtgactctccgtcaaccagcatcgcctggtgcggtagtcacacttcatggaagatttgagatattatcattatctggctctttcctgccgccgcctgctccaccagcggcgtcaggattagccatatatctagctggtggacaaggacaggtcgtcggtggtagcgtggtgggaccgttgttagcttccggtccggttgttatcatggcagcttcctttggaaatgctgcttatgaaaggctacctttagaagatgaagaaacaccagtgaatgtgccaggaaatggagggttagggtcaccgggaaccatgggaagtcaacaacaacagcagcagaaccagcaacagcaacaacttgtagcagatcctaatgcttcatcacttttccatggagttcctcaaaatcttctcaattcatgccaattaccagctgaaggttattggggtggaagtgctcgtcctccttttttaaccaaaaatgttattcacttaatcacttttctcatcatgtttttcgtttaa

SEQ ID NO: 189 - protein, 325 aa, Medicago truncatula
MDQVAQGRPLPPPFLTRDLHLHPHHQFHTNHQTNEEEQQSGNGSLSRGQKRERNNEDGNNTPTGGEGKDDGGSGSAGGGSGGEMGRRPRGRPAGSKNKPKPPIIITRDSANALRSHVMEVANGCDIMESVTVFARRRQRGVCILSGSGTVTNVTLRQPASPGAVVTLHGRFEILSLSGSFLPPPAPPAASGLAIYLAGGQGQVVGGSVVGPLLASGPVVIMAASFGNAAYERLPLEDEETPVNVPGNGGLGSPGTMGSQQQQQQNQQQQQLVADPNASSLFHGVPQNLLNSCQLPAEGYWGGSARPPFLTKNVIHLITFLIMFFV

SEQ ID NO: 190 - protein, 6 aa, Artificial sequence
  motif 1
  VARIANT (4)..(4): Xaa is Ile or Val
QGQXGG

SEQ ID NO: 191 - protein, 15 aa, Artificial sequence
  motif 2
ILSLSGSFLPPPAPP

SEQ ID NO: 192 - protein, 8 aa, Artificial sequence
  motif 3
NATYERLP

SEQ ID NO: 193 - protein, 12 aa, Artificial sequence
  motif 4
SFTNVAYERLPL

SEQ ID NO: 194 - protein, 42 aa, Artificial sequence
  motif 5
GRFEILSLTGSFLPGPAPPGSTGLTIYLAGGQGQVVGGSVVG

SEQ ID NO: 195 - DNA, 654 bp, Oryza sativa; identical to SEQ ID NO: 109

SEQ ID NO: 196 - DNA, 51 bp, Artificial sequence
  primer
ggggacaagtttgtacaaaaaagcaggcttaaacaatggatccggtcacgg

SEQ ID NO: 197 - DNA, 49 bp, Artificial sequence
  primer
ggggaccactttgtacaagaaagctgggtggaatcgatccatctcagaa

SEQ ID NO: 198 - DNA, 828 bp, Arabidopsis thaliana
atgggtggatcgatgtcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggctcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtga

SEQ ID NO: 199 - protein, 275 aa, Arabidopsis thaliana
MGGSMSERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 200 - protein, 63 aa, Artificial sequence
  DOF domain
PLAGPLKCPRCDSSNTKFCYYNNYNLTQPRHFCKGCRRYWTQGGALRNVPVGGGCRRNNKKGK

SEQ ID NO: 201 - DNA, 684 bp, Arabidopsis thaliana
atggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgctccggtga

SEQ ID NO: 202 - protein, 227 aa, Arabidopsis thaliana
MAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTLR

SEQ ID NO: 203 - DNA, 993 bp, Arabidopsis thaliana
atgcctacgaattcgaatcatcagcatcatcttcaacaccagcttaacgaaaatggaagtataataagtggccacggactagtactctctcaccaacttccacctctccaagcaaaccctaaccctaaccaccaccatgtcgctacctctgctggtcttccgtcaaggatgggtggatcgatggcggagagagcaaggcaggccaacattcctccactagcgggacccctaaagtgtcctcgatgcgactccagcaacactaagttctgttactacaacaactataacctcactcagcctcgttacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcaatacttttggcctggttcggatttctcgggtccttctaatgatatcttg

SEQ ID NO: 204 - protein, 331 aa, Arabidopsis thaliana
MPTNSNHQHHLQHQLNENGSIISGHGLVLSHQLPPLQANPNPNHHHVATSAGLPSRMGGSMAERARQANIPPLAGPLKCPRCDSSNTKFCYYNNYNLTQPRYFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDIL

SEQ ID NO: 205 - DNA, 873 bp, Oryza sativa
atgattccgggcacgcttgccgatggcggcggcggaggcggcgcggtggggccggcgaagccgatgtcgatgtcggagagggcgcggctggcgaggatcccgctgccggagccggggctcaagtgcccgcgctgcgactccaccaacaccaagttctgctacttcaacaactactccctctcccagccccgccacttctgccgcgcctgccgccgctactggacccgcggcggcgcgctccgcaacgtccccgtcggcggcggctaccgccgccacgccaagcgcgccaagcccaagccggcgtccgcggcgggctccgcctcagccgccaccaccaccgccggctcgacgccagcggggtcgacgacgacgacgacgacgtcctccacctgcgccacgcccaacgcgcccgccctcccggcgatgctgggcggcaacctctccatcctgccgccgctgctccgcctcgccgacttcgacgccatgagcctcggctccaccttctctggcatggcggcggccgccggcaagccaccgcccgtcgacgcggccggctgctactccgtcggcgccgccaccggcctcgagcaatggagactacagcagatgcagagcttcccgttcttccacgccatggatcaccaggcggcgatggcggcgccaccgccggcaatggcaatgccggggatgttccagctaggcctagacggcgacggccatggcagcggcggcggcgaagacggtggagagctccaccatgcgatgccatcatcgaagagagaaggctacccaaggggcatgtatggcgatcatcacctcgctggaggatacacctcctactccagtgcaaccacaggtaaccatctcttgtaa

SEQ ID NO: 206 - protein, 290 aa, Oryza sativa
MIPGTLADGGGGGGAVGPAKPMSMSERARLARIPLPEPGLKCPRCDSTNTKFCYFNNYSLSQPRHFCRACRRYWTRGGALRNVPVGGGYRRHAKRAKPKPASAAGSASAATTTAGSTPAGSTTTTTTSSTCATPNAPALPAMLGGNLSILPPLLRLADFDAMSLGSTFSGMAAAAGKPPPVDAAGCYSVGAATGLEQWRLQQMQSFPFFHAMDHQAAMAAPPPAMAMPGMFQLGLDGDGHGSGGGEDGGELHHAMPSSKREGYPRGMYGDHHLAGGYTSYSSATTGNHLL

SEQ ID NO: 207 - DNA, 1068 bp, Oryza sativa
atgccgccgcatcacggcggcctcatggcgcctcggcctgacatggtagcagcggccgtcgcggcgagcggcggcggcggtggcggcggcggcccgaccggcggcacggcggtgcggccgggctcgatgacggaacgggctcggctggcgaagatcccgcagccggagccggggctcaagtgcccgcgctgcgagtccaccaacaccaagttctgctacttcaacaactactcgctctcgcagccgcgccacttctgcaagacgtgccgccgctactggacgcgcggcggagcgctccgcaacgtccccgtcggcggcgggtgccgccgcaacaagcgcaccaagtcgtccaagtcgtcctcgtcgacgtcggccgccggctcggcctccgccaccggcggcacgtcgtcgtccacatcgtcgaccgccacgggtggcagcagcagcgccgcggcggccgcggcgatgatgccgccgcaggcgcagctgccgttcctggcctcgttgcaccacccgctcggcggcggcgatcactacagctccggtgcgtccaggctagggtttcccggattgagctcgctggatcccgtcgactaccagctcggcggcggcgccgccgccgccgccgccatcgggctagagcagtggcgcctcccgcagatacagcaattccccttcttgagccgcaacgacgccatgccgccgccaatgtccggcatttacccgttcgacgcggaggccgccgccgacgccgccggcttcgccggccagttgctggccggcaccaaggtgcccggctcgtcgggcctgatcacgcagctcgcatccgtcaagatggaggacagcaacgctcagtccgcggcgatgaacagctcgccgagggagttcttgggcctccccggcaacctccaattctggggcggtggcaacggcgcgggacccggcggcaatggagacggcgccaccggcggcagcggcgccggtgtcgctccgggaggcggcggcagcggcggcggatgggctgatctctccggattcaactcgtcgtcgtcggggaacatactgtga

SEQ ID NO: 208 - protein, 355 aa, Oryza sativa
MPPHHGGLMAPRPDMVAAAVAASGGGGGGGGPTGGTAVRPGSMTERARLAKIPQPEPGLKCPRCESTNTKFCYFNNYSLSQPRHFCKTCRRYWTRGGALRNVPVGGGCRRNKRTKSSKSSSSTSAAGSASATGGTSSSTSSTATGGSSSAAAAAAMMPPQAQLPFLASLHHPLGGGDHYSSGASRLGFPGLSSLDPVDYQLGGGAAAAAAIGLEQWRLPQIQQFPFLSRNDAMPPPMSGIYPFDAEAAADAAGFAGQLLAGTKVPGSSGLITQLASVKMEDSNAQSAAMNSSPREFLGLPGNLQFWGGGNGAGPGGNGDGATGGSGAGVAPGGGGSGGGWADLSGFNSSSSGNIL

SEQ ID NO: 209 - DNA, 1000 bp, Triticum aestivum
ctcctagctcgtcgacaagcatgcccacaaagccactgataacaagcgcatagcagcgcacgctctcttatagtagaatgttctgaactccacaccagcccatgcaagacttccagtccatcccgggcctcgccgggcggctgttcggcggcgcggccgcggcagacatccggcgcgtgcagggcccggcgtcccggtgcggcgtgttctcgcaggcggcgtccgcgcagccggaggcggccgtcaagtgcccgcggtgcgagtccaccaacaccaagttctgctactacaacaactacaacctgtcgcagccgcgccacttctgcaagagctgccgccggtactggaccaagggcggcgtcctccgcaacgtccccgtcggcggcggctgccgcaaggccaagcgcagctcctcgtcggcgtccgcaccgtcgacgcccgcggccacggacgccaagagccagcggcgcgcgtccgcgtcgtcctcctcccgctccaacagcggcagcggcagcgccagccccacggccgctgcggaagagacgacgacaacggagaccgagccccctcctccgcccacgccgtcgtccaactccaactccaacgcggtctccttcgccaaccgcatgacgaactaccccttcgcggcagacgtgccacctctggcgccgatattcgccgaccaggccgccgcgctcgcgtccctcttcgcgccgcctcctccaccgcctctcccggtgttcagcttctcggcggagcccaagatggaggaggcgatcgggtcactgctgctcccggggcaggaggcgtcgcaggagccagaggagcccacctgcacctccaccgtcgcggacatggcgccgttcatgtcgctggacgcggggatcttcgagctcggcgacgcgtcgccggccgattactggaacggcgggagctgctggacggacgtccaggacccgtccgtctacctaccctagtttggcttagttcctcatcacga

SEQ ID NO: 210 - protein, 291 aa, Triticum aestivum
MQDFQSIPGLAGRLFGGAAAADIRRVQGPASRCGVFSQAASAQPEAAVKCPRCESTNTKFCYYNNYNLSQPRHFCKSCRRYWTKGGVLRNVPVGGGCRKAKRSSSSASAPSTPAATDAKSQRRASASSSSRSNSGSGSASPTAAAEETTTTETEPPPPPTPSSNSNSNAVSFANRMTNYPFAADVPPLAPIFADQAAALASLFAPPPPPPLPVFSFSAEPKMEEAIGSLLLPGQEASQEPEEPTCTSTVADMAPFMSLDAGIFELGDASPADYWNGGSCWTDVQDPSVYLP

SEQ ID NO: 211 - DNA, 1230 bp, Zea mays
aggtggtggcgggggacaggttgggggccccgccaagcccatgtccatggcggagcgcgcgcgcctcgcgaggatcccactgccggagccgggactcaagtgcccgcgctgcgactcaaccaacaccaagttctgctacttcaacaactactccctcacgcagccgcgccacttctgccgggcctgccgccgctactggacgcgtggcggcgcgctccgcaacgtgccggtcggtggcggataccgccgccacgccaagcgcgccaagcccaagcagcagcagcagcacgcggccgccgggaccggagctgccaacggcgcgatgcagcagcctcccgctgggtctatggcgtcgtcggccgccgcctgcaccgcgaccacgacgatgacgaccaacgcgctggacgccgggcccggcggcatgctgcccatgctgccgccgctcgtccgcctagcagacttcgacgcaatgagcctcggctccagcttctccgggatatcgtccatggggaagcccggatccatcggcgcggcctgctacccgcactctgtcggcgggctggagcagtggagggtgcagcagatgcagagcttcccgttcttgcatgcgatggaccagggcccgctggggccacctctggccatggcgatggcggcgccaggagggatgttccagctaggtctagacaccaccagtgataacagccgtggcggtggcggcggcggctgcggcgaagacgggtcgtctgcgggagaggcgctccatatgatgcaagcagccaccaagagggagagctacccggcaccaccaagagccatgtacggcgaccaacaccacaatcacctcgctgctgctggtggctacacttcctattccaccaatgctgctgcaggtaaccatctcttgtaatggccggccgatcgatcgatcgagagctcaacaattcaagtgtcctgctatagctagctactacgacgtcgtgctacgatcgtatcggtttcggttcgttcctacaaatatagcctagagatagagtgtctctgtctgtgtgatcgatggtattgttatgatcatatagaaaagaccagtgtagcatgcatgcacttgttgcaatgtttgctttcaagaagaaactggagggaggagaggctcggtttggatgctgatcatgcacaaatattactagtgtctacagctgctacttcattataaaaaaaaaaaaaaaaaaa

SEQ ID NO: 212 - protein, 302 aa, Zea mays
GGGGGQVGGPAKPMSMAERARLARIPLPEPGLKCPRCDSTNTKFCYFNNYSLTQPRHFCRACRRYWTRGGALRNVPVGGGYRRHAKRAKPKQQQQHAAAGTGAANGAMQQPPAGSMASSAAACTATTTMTTNALDAGPGGMLPMLPPLVRLADFDAMSLGSSFSGISSMGKPGSIGAACYPHSVGGLEQWRVQQMQSFPFLHAMDQGPLGPPLAMAMAAPGGMFQLGLDTTSDNSRGGGGGGCGEDGSSAGEALHMMQAATKRESYPAPPRAMYGDQHHNHLAAAGGYTSYSTNAAAGNHLL

SEQ ID NO: 213 - DNA, 1243 bp, Solanum tuberosum
gaggacttatcaacctttttatataaaagagataaagatcaaagagatcaaagaaagaaaatcatggttttctcatcttttcctgtgtatctagatcatcccaatttgcatcagttacaacagccagacggccatcaacaaggaaatactgggctggagaatccaactctgcagcccccacctatgcaggtgggggctagtccgggctcaatcagaccaggttctatggtggatcgagcccggttagctaagattccactaccggaagctggattaaagtgtccaaggtgtgattcaacaaacacaaagttctgctacttcaacaactacaacctttcccaaccaagacacttctgcaagacctgtcgccggtactggactagagggggcgccttgagaagcgtgccggtaggaggaggatgccggaggaacaagagaagcaaaagtaataacaacaacaacagctcaaagacagctggcagtaatgtcaatactaatactattgcttccggtacttcaacaagtgcaagtccttcaagctgcagcacggaaataatgaatggtcgccatcacttctctcatgagcaaccaccgcagttaactcctctcatggctgctttccaaaatcttaatcatcactatggcggatttcaacctcctcctttggtttcaacacaccatgggaatggaaccggcgcgcttggtcatcatcatgaaatgggatttcaaatagggagtagtactaatactaacaatttacctgtacccccaggaggaggatctgatcatcagtggagattaccatctttggcagcaaacacaaatttgtacccttttcaacacggtactgatcaaggaattcatgaatcatcatctgttaacaataataatattaatgctcatgatgaccaagggttaaattcgaccaaacagtttttgggaacaatggaaaataatactaatcaatattggggtggaaacgcatggacagggttttctggattaaactcatcttcttcagcaagccatctactttgatttcattcatgtaagtcaatttgtgtacttgactctcaacgattaaaatgttgtatgtgttgggaggggggtctaaattagatatatagtatactgggggcatgtttaagtctttgttattccatggtcattatcaccacttgtaattttactggatgttttttttttataacttaggtgtgtgaagttgtattgtgagttttaa

SEQ ID NO: 214 - protein, 324 aa, Solanum tuberosum
MVFSSFPVYLDHPNLHQLQQPDGHQQGNTGLENPTLQPPPMQVGASPGSIRPGSMVDRARLAKIPLPEAGLKCPRCDSTNTKFCYFNNYNLSQPRHFCKTCRRYWTRGGALRSVPVGGGCRRNKRSKSNNNNNSSKTAGSNVNTNTIASGTSTSASPSSCSTEIMNGRHHFSHEQPPQLTPLMAAFQNLNHHYGGFQPPPLVSTHHGNGTGALGHHHEMGFQIGSSTNTNNLPVPPGGGSDHQWRLPSLAANTNLYPFQHGTDQGIHESSSVNNNNINAHDDQGLNSTKQFLGTMENNTNQYWGGNAWTGFSGLNSSSSASHLL

SEQ ID NO: 215 - protein, 996 aa, Arabidopsis thaliana
ATGCCTACGAATTCGAATCATCAGCATCATCTTCAACACCAGCTTAACGAAAATGGAAGTATAATAAGTGGCCACGGACTAGTACTCTCTCACCAACTTCCACCTCTCCAAGCAAACCCTAACCCTAACCACCACCATGTCGCTACCTCTGCTGGTCTTCCGTCAAGGATGGGTGGATCGATGGCGGAGAGAGCAAGGCAGGCCAACATTCCTCCACTAGCGGGACCCCTAAAGTGTCCTCGATGCGACTCCAGCAACACTAAGTTCTGTTACTACAACAACTATAACCTCACTCAGCCTCGTCACTTCTGCAAAGGTTGCCGTCGCTACTGGACACAAGGGGGCGCCCTGAGAAACGTCCCTGTAGGTGGAGGCTGCCGGAGGAATAACAAGAAGGGCAAAAATGGAAATTTAAAATCTTCTTCTTCTTCGTCCAAACAGTCTTCCTCGGTCAACGCTCAAAGTCCTAGCTCAGGACAGCTAAGGACAAATCATCAGTTCCCTTTTTCACCAACTCTTTACAATCTCACTCAACTCGGAGGTATTGGTTTGAACTTAGCCGCTACTAATGGCAACAACCAAGCTCACCAGATCGGTTCCAGTTTGATGATGAGCGATCTAGGGTTTCTCCATGGACGAAATACTTCAACTCCGATGACGGGAAACATTCATGAAAACAACAACAATAATAACAATGAAAACAACCTAATGGCATCCGTTGGATCTTTGAGCCCCTTTGCTCTCTTCGATCCAACGACGGGGCTATACGCTTTCCAGAACGACGGTAATATCGGGAACAACGTTGGGATATCTGGTTCTTCTACTTCCATGGTTGATTCTAGGGTTTATCAGACGCCTCCGGTGAAGATGGAAGAACAACCTAATTTGGCTAACTTGTCTAGACCGGTCTCCGGTTTGACGTCTCCTGGGAATCAAACAAATCAGTACTTTTGGCCTGGTTCGGATTTCTCGGGTCCTTCTAATGATCTCTTGTGA

SEQ ID NO: 216 - protein, 275 aa, Arabidopsis thaliana
MGGSMAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 217 - DNA, 993 bp, Arabidopsis thaliana
atggttttctcctccatccaagcctatcttgattcatccaactggcaacaggctcctccgagcaattataatcatgacggaacaggcgcctcagcaaatggaggtcatgttcttcgtcctcagctgcagccacagcagcagccacagcagcagccgcatcctaatgggagcgggggcggaggtggaggtggaggcggctcgatccgagcaggatcaatggtggacagagcaagacaagcaaacgtagccttgccagaagcagcactgaaatgtccgagatgcgaatccaccaacaccaagttctgctacttcaacaactacagcctcactcaaccacgccacttctgcaagacctgccggagatactggacacgtggcggagctctccgcaacgtcccagtcggcggtggctgccggagaaacaggcgtaccaaaagcaacagcaacaacaacaataacagcactgctactagcaataacaccagtttctcctccgggaatgcatccaccatcagcacgattctctcctcccactatggaggaaaccaagagagtatcttaagccagattttgtctccggcgaggctaatgaatcctacttacaatcatctcggagatctcacaagtaatacaaaaacagacaacaacatgagcttgttgaactatggaggattgagtcaagacttgaggtcaatccacatgggagcttctggtggctcgcttatgagctgtgttgatgaatggagatcggcgtcttatcatcagcagtcaagtatgggcggtgggaacttggaggattcttctaatcctaatccatccgcaaatgggttttactcttttgagtcgccgaggataacttcagcgtcaatctcttctgctttagcatcgcagttttcttcggttaaagttgaagataatccttacaaatgggttaatgtcaatggtaattgctcttcctggaatgatctttctgctttcggctcttctcgttga

SEQ ID NO: 218 - protein, 330 aa, Arabidopsis thaliana
MVFSSIQAYLDSSNWQQAPPSNYNHDGTGASANGGHVLRPQLQPQQQPQQQPHPNGSGGGGGGGGGSIRAGSMVDRARQANVALPEAALKCPRCESTNTKFCYFNNYSLTQPRHFCKTCRRYWTRGGALRNVPVGGGCRRNRRTKSNSNNNNNSTATSNNTSFSSGNASTISTILSSHYGGNQESILSQILSPARLMNPTYNHLGDLTSNTKTDNNMSLLNYGGLSQDLRSIHMGASGGSLMSCVDEWRSASYHQQSSMGGGNLEDSSNPNPSANGFYSFESPRITSASISSALASQFSSVKVEDNPYKWVNVNGNCSSWNDLSAFGSSR

SEQ ID NO: 219 - DNA, 972 bp, Arabidopsis thaliana
atggttttctcatctcttccagtgaatcagttcgattcccaaaattggcagcagcaagggaaccaacatcagctagaatgtgtcacaactgaccagaaccctaataattacttacggcagctctcatcaccaccgacttctcaggttgcaggttcgagtcaagctagagtgaattcaatggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaa

SEQ ID NO: 220 - protein, 323 aa, Arabidopsis thaliana
MVFSSLPVNQFDSQNWQQQGNQHQLECVTTDQNPNNYLRQLSSPPTSQVAGSSQARVNSMVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 221 - DNA, 1200 bp, Arabidopsis thaliana
atggttttttcttcatttcctacttatcctgatcattcatcaaactggcaacaacaacatcaaccaatcacaaccaccgttggattcacgggaaataacatcaaccaacagtttcttcctcaccatcccctcccaccgcaacagcaacaaacgcctccgcagcttcaccacaacaacggtaacggcggagtcgctgttcccggtggacctggcgggttaatccgaccaggttcgatggcggaaagagcaaggctagccaacataccattacctgaaacagccttgaagtgtccaagatgtgactcaactaacaccaaattctgttacttcaacaactacagtctcactcaacctcgccacttctgcaaagcatgccgtcgttactggacacgtggcggtgctctaaggagcgttcccgtcggtggcggttgccgtagaaacaaaagaaccaaaaacagcagcggtggaggtggcggtagcaccagtagcggtaacagcaagtcacaagacagcgccacgagcaacgaccaataccaccaccgagccatggctaacaatcagatgggaccaccttcttcgtcatcgtctctaagctcgttgctgtcttcttacaacgcagggttaatccccggacatgatcataacagcaataacaacaacatacttggacttggatcatctttgcctcctcttaagcttatgcctcctttagacttcacagacaacttcaccttacaatacggtgccgtttcagctccttcttatcatataggcggtggaagcagtggaggagcggcggctcttttaaacggttttgaccagtggagattcccggcaacaaaccaacttcctttaggcggtttagacccgtttgatcaacaacatcaaatggagcagcagaatccaggttacggattggttaccgggtcgggtcagtatcgacctaagaacattttccataaccttatctcctcttcttcgtctgcttcatcagctatggttacagccaccgcgtcgcaattagcttcagtgaaaatggaagatagtaacaatcagctcaacttgtctagacaactttttggagacgaacaacagctctggaatattcatggcgctgctgcagcatccaccgcagctgcaacaagttcgtggagtgaagtctctaataatttcagttcttcttctactagcaatatataa

SEQ ID NO: 222 - protein, 399 aa, Arabidopsis thaliana
MVFSSFPTYPDHSSNWQQQHQPITTTVGFTGNNINQQFLPHHPLPPQQQQTPPQLHHNNGNGGVAVPGGPGGLIRPGSMAERARLANIPLPETALKCPRCDSTNTKFCYFNNYSLTQPRHFCKACRRYWTRGGALRSVPVGGGCRRNKRTKNSSGGGGGSTSSGNSKSQDSATSNDQYHHRAMANNQMGPPSSSSSLSSLLSSYNAGLIPGHDHNSNNNNILGLGSSLPPLKLMPPLDFTDNFTLQYGAVSAPSYHIGGGSSGGAAALLNGFDQWRFPATNQLPLGGLDPFDQQHQMEQQNPGYGLVTGSGQYRPKNIFHNLISSSSSASSAMVTATASQLASVKMEDSNNQLNLSRQLFGDEQQLWNIHGAAAASTAAATSSWSEVSNNFSSSSTSNI

SEQ ID NO: 223 - DNA, 52 bp, Artificial sequence
  primer: prm07315
ggggacaagtttgtacaaaaaagcaggcttaaacaatgggtggatcgatggc

SEQ ID NO: 224 - DNA, 50 bp, Artificial sequence
  primer: prm07316
ggggaccactttgtacaagaaagctgggtcgttaatgatccgacaaaaca

SEQ ID NO: 225 - DNA, 2193 bp, Oryza sativa; identical to SEQ ID NO: 5

SEQ ID NO: 226 - DNA, 1344 bp, Arabidopsis thaliana
  misc_feature (196)..(196): n is a, c, g, or t
  misc_feature (461)..(461): n is a, c, g, or t
atgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttnacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcntgtgggggcaggacgtcgtaagaacaaaagcttatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaacgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttag

SEQ ID NO: 227 - protein, 447 aa, Arabidopsis thaliana
  UNSURE (66)..(66): Xaa can be any naturally occurring amino acid
  UNSURE (154)..(154): Xaa can be any naturally occurring amino acid
MMMETRDPAIKLFGMKIPFPSVFESAVTVEDDEEDDWSGGDDKSPEKVTPELSDKNNNNCNDNSFXNSKPETLDKEEATSTDQIESSDTPEDNQQTTPDGKTLKKPTKILPCPRCKSMETKFCYYNNYNINQPRHFCKACQRYWTAGGTMRNVXVGAGRRKNKSLSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 228 - protein, 63 aa, Artificial sequence
  DOF domain
  UNSURE (50)..(50): Xaa can be any naturally occurring amino acid
KPTKILPCPRCKSMETKFCYYNNYNINQPRHFCKACQRYWTAGGTMRNVXVGAGRRKNKSLSS

SEQ ID NO: 229 - protein, 11 aa, Artificial sequence
  motif 1
KALKKPDKILP

SEQ ID NO: 230 - protein, 14 aa, Artificial sequence
  motif 2
DDPGIKLFGKTIPF

SEQ ID NO: 231 - protein, 11 aa, Artificial sequence
  motif 3
SPTLGKHSRDE

SEQ ID NO: 232 - protein, 16 aa, Artificial sequence
  motif 4
LQANPAALSRSQNFQE

SEQ ID NO: 233 - protein, 32 aa, Artificial sequence
  motif 5
KGEGCLWVPKTLRIDDPDEAAKSSIWTTLGIK

SEQ ID NO: 234 - DNA, 1263 bp, Oryza sativa
atgaacaacgttgaagagaaagcagcatcagactcaaaagatgaaaatgaaaagacagcaaatgatgaatcaggccaggacaaagtacttaagaagccagataagattctcccttgccctcggtgcaacagtatggacacaaagttttgttattacaacaactacaatgttaatcaacccaggcacttctgtaagaactgccaaaggtattggactgccgggggaaccatgagaaatgtacctgttggtgctgggaggcgcaaaagcaagagctcatcgttgcactaccgtcacttactgatggcccctgattgcatgatggggtctagagtggaaatatccaagtcaatgaaccctgaagctttcgcatctgcgcattcgacccctatacaaccaattggcagaaacgaaacagttctcaaatttgggcctgaggtgccactctgtgaatcgatggcatcagtgctgaacattcaggagcagaatggaaccaatgctgcagcagtaccaacgggtgaaaatcaggaagataactcttgcatctcttcaatcacatcacacaacgtgttacctgaaaatgcagcccaagttgacaagaacagcacgccggtgtattgcaacggagtcggcccagtgccgcagtactaccttggagctccttacatgtacccatggaacataggatggaacaacgttcctatgatggtgccaggtacaagcatgccagagtctgcttcccaatctgagagctgcagcaccagttcagctccatggatgaacatgaactcccccatgatgccggttgcctcgaggctttctgcaccaccatttccataccctctagtgccacctgcactatggggttgcttatccagctggccggccacggcatggaacataccgtggatcagaacgaatggcggctgcatgtctccatcgtcgtcgagcaacagcagctgttcaggcaatggctcccctctggggaagcattccagggactcctctctcccactgaaggaggacaaggaggagaaatcactgtgggttcccaagacgctccgcatcgacgatcccgacgaggcggcgaagagctccatctgggccaccctggggatcaagcctggagaccctggcatcttcaagccgttccagtccaaaggtgagagcaaaggccaagcagcatcagagactcgtcctgctcgtgctcttaaggcaaacccagctgcattgtcgcggtcgcagtcgttccaggagacttcttga

SEQ ID NO: 235 - protein, 420 aa, Oryza sativa
MNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 236 - DNA, 1365 bp, Oryza sativa
atgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccagcaacactgaaggaaaatgaaacacctacagaattcatatcagaagtaccaccatgtaagtcttcagcttcaatccttgatattggagagccgaatgatactgaccttgttcccttggcctctggtgataacaaggaagaaaaatcatgtgcatcttctgtggtagtatccagctgttcagagaatctgatgccagataatgcaattatgaaagagccaaacaacaggtcaggatgttgtaatggtgtggcattgcctttccctactggacctgctttggtgctcccctggagtcttggatggaacagtgttgctctcatgccagctacccagtgctcgatgcagcccgttcttgggttaaaagatgggataccctgcccgccttcatggccaccgcaactgatggtgccggccccaggaatctgtactcctgttgttccaatccctcttgtgccacctctgtggagctgcttccctggctggcctaatggaatgtggaatgcacaatgccctggaggtaatactactgtgctgccgtcaaccgctccaaacaaaatttcttgttcaggaagcagttctctggtgttgggaaagcattcaagagaagaaagcttgcaggaagaagagaagacgagaaattacttatgggtacctaaaactcttaggattgatgatccagctgaggctgcaaagagttcaatctgggcgacccttggcatcaagcctgacgataaaggcatattcaagtctttccagccaaatgttgcgaaaaatggcacggcaccagaatcgcctcaggctctgcaggccaatccagcagcattttcgcgttctcaatcgtttcaagagacgacttga

SEQ ID NO: 237 - protein, 454 aa, Oryza sativa
MPNLGNGVKTNNDLPLVSDKLLIVKGIPFCPNNSKKNDLQGISRPDGRIEIDSMTEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEVPPCKSSASILDIGEPNDTDLVPLASGDNKEEKSCASSVVVSSCSENLMPDNAIMKEPNNRSGCCNGVALPFPTGPALVLPWSLGWNSVALMPATQCSMQPVLGLKDGIPCPPSWPPQLMVPAPGICTPVVPIPLVPPLWSCFPGWPNGMWNAQCPGGNTTVLPSTAPNKISCSGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 238 - DNA, 1461 bp, Oryza sativa
atgggagggggtggtaagtgcaaaagagggaaaagaggaaagattgcagccaagcgaagaaggggccagtgttgcagcagcagcagcagcagcggaggcgcaagaagacgagctagagagagagaatcagaggagagcttgggtgagatgggtgagtgcagaggaggaggaggaggaggagatgggctgatcaagctgttcgggaagacgatcccggtgcagccggatgccaaggatgttcagcagcatagtggcagtagcagcagctcaaccgaatccgacgtccaagaaaccgccgctgtcgccgtcgccgacccctccccgcggtcggaggtcgtcgacggcgagagcccgccgcagccgggcggcgaggcggcgagccatcagcagcagcagaaggagatgaagctgaagaagccggacaagatcctgccatgcccgcggtgcagcagcatggacaccaagttctgctacttcaacaactacaacgtcaaccagcctcgccacttctgcaagcactgccagcgctactggaccgccggcggcgccatgcgcaacgtccccgtcggcgccggccgccgcaagaacaagaacgccaccgccgccgcccacttcctccaccgcgtccgcgcctgcgccgccgccgccgccatgcccgcggcgccccacgacgccaccaacgccaccgtgctcagcttcggcggcggcggaggcggacacgacgcgccgccggtcaccctggacctcgccgacaagatgacgcgcctcggcaaggaggggctcgtcgcccatgcccggaacgccgacgccgccgccgcgtgcagcgaggtgtcgagcaacagggacgacgagcagatcggcaacactgtagcaaaacctgcaaacgggttgcagcagcatcctcctcctcctcatcatcatcatcattcagccatgaacggtggcggcatctggccctactacacctcggggatcgcgatcccgatatacccggcggcgccggcgtactggggctgcatgattccacctcctggagcttggagcctcccatggccggccacagtccagtctcaggccatctcatcatcatcaccacctacaagtgctacaccttcagtctcctccttcacactaggcaagcatcccagagagggtggtgatcatgaggcaagagatcaccatggcaatggtaaagtgtgggtgccgaagacgatccggatcgacaacgccgacgaggttgcccggagctcaatccggtcactcttcgccttcagaggcggcgacaaggcggatgataacaacgacgacgatggcaccggcgtgcacaagctcgccaccacggtgttcgagccaaagagggacagcaagacggcgaaacatccggcgatcacgagcttgccgctcttgcacaccaaccccgtcgcgcttacccgatccgcgaccttccaggagggatcttga

SEQ ID NO: 239 - protein, 486 aa, Oryza sativa
MGGGGKCKRGKRGKIAAKRRRGQCCSSSSSSGGARRRARERESEESLGEMGECRGGGGGGDGLIKLFGKTIPVQPDAKDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 240 - DNA, 1461 bp, Oryza sativa; identical to SEQ ID NO: 238

SEQ ID NO: 241 - protein, 440 aa, Oryza sativa
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 242 - DNA, 1803 bp, Oryza sativa
acttgtcggatctctctctctctctctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatc

SEQ ID NO: 243 - protein, 476 aa, Oryza sativa
MDDLAAASPPHPPPPPPESHVPPPPQTPEKDSCEDTGDMRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 244 - DNA, 1817 bp, Hordeum vulgare
ctagacatgattgccaagctcgaaaataaccctcacaaagggaacaaaactggtaccgggccccccctcgaggtcgacaaggtcggtgtccatgccccctccccctcctcctttgtgttcttgtgtatgaaatcccgggaattttgattggtttctaatagagcctgtgaaaaaaaaaaaggccatttcgaggcctgctttctttggctttggagccgatcatggcgacgagtcgtgtttggtctagtcatcaggtcttaagcatggagttccctgcctgttttgggaggtactagtaagcgctaagcaggcaggtttagcttccattagcaagggaatttcgcctttgctggtctctaataataatagcagtttcaacagttttagtattgcatgatctagtcgtctgaacatctggacttctgaaagacaggcctttctaggttattatcttgcctcttttaataggtcgttttcgcgtgctcccaaggattttgctgaaagtggctactgatatgtgttgccgtaacctactggacttcagaagttcagatgcgtccgactctgagtacatcacccactgcaaatcaaagcaccatagcttctttttttcattaacaagatataagaactgggaatatgaacaaactttgtcaaattttacacttgggtcagatgggggaaagcatgttgtaatcaccggtcaataacccgaatattacaccgtgtttgtggacctctaattcacaacaaaattatttcaaagttagactatatatatatacaaggaactcatcgagattttctgaatgtttacaggaccttcagcacagaggaagcaccacggctgaaccgaaagtacaagaaagcgccccacaggactccacgggctcgcctccgcagccggaggttgtggacgtcgaggatccatctgctgtcaagaactcagcagcagatcaacaagaagaagaagaagaacagggtgacacggccaaccagaaggagaagctcaagaagcctgacaagatcctgccctgcccacgctgtagcagcatggacaccaagttctgctactacaacaactacaacatcaaccagccgcgccacttctgcaagaactgccagaggtactggacggccggcggggccatgcgcaacgtgcccgtgggcgcgggccgccgcaagagcaagagcatatcggcagcgtcccacttccttcagaggataagggccgctctgcccggtgatcctctctgcaccccggtcaacactaacggcacggtgctcagcttcggctccgacgcatccaccttggacgtcgtctcagaacagatgaagcacatgaaggagctcagctcagtaacccggaccgagaacaccgatgccccgtcagtagggtcttgtgctgaaggatgggcaaagggagaagagtcgagccagatgaactcgagggagagagttgcagcagatagatcgccaaattttgcgcagcacccgtgcatgaacggggcagccatgtggccattcagttgtgcaccatcgcctgcctatttcaccccaaacgtagcaattccattctatccagctgctgctgctgcctactggggctgcatggttccgggagcctggaacactccatggcagccgcagccgcagccgcagtctcagtgtcaatctagctcaccacctagtgccgcttctccggtatcaacaatgtccagttgcttccaatcccggaagcatcctagagatggtgatgaggaaagagataccaagggtaatggcaaggtgtgggtgcccaagacgatcgagtcgac

SEQ ID NO: 245 - protein, 270 aa, Hordeum vulgare
LKKPDKILPCPRCSSMDTKFCYYNNYNINQPRHFCKNCQRYWTAGGAMRNVPVGAGRRKSKSISAASHFLQRIRAALPGDPLCTPVNTNGTVLSFGSDASTLDVVSEQMKHMKELSSVTRTENTDAPSVGSCAEGWAKGEESSQMNSRERVAADRSPNFAQHPCMNGAAMWPFSCAPSPAYFTPNVAIPFYPAAAAAYWGCMVPGAWNTPWQPQPQPQSQCQSSSPPSAASPVSTMSSCFQSRKHPRDGDEERDTKGNGKVWVPKTIEST

SEQ ID NO: 246 - DNA, 1485 bp, Cucurbita maxima
cagctgcaaaagaggaaactcttcatgattcagaggattatgcatgtgtaaaaacagcaaatgaggcgcacatgaatcctgaagtgttatcaacagatgaaaatgataagctcgcaacaaggaaaactgagaaagaacagaatgatgcccccaactcgaaagagaaactgaagaaaccagataagatacttccatgtccccgctgcaatagcatggaaaccaagttttgttattataataattataatgtcaatcaaccacgccatttttgcaaagcctgtcaaagatattggactgaaggcggtaccatcaggaatgtccctgttggagctggccgccgaaaaaacaagaactcagcctcacactaccgacacattacaatctcagaggctctccgagctgcacaaattgatgttcctattgaggtcaaccacctagcatcaaaaggcaatggacgagtcctcaatttcagtgtaagcccacctgtatgtgaatctatggtcaatgtatcacatcctgcagaaagaaaggtcttgaatggaacaaggaatgaatttgagggagccaaaggaccttgtgagggtggggaaactggtgatgattgttctagtgcatcttcagtaacaatgtcaagctcaatgaagaatggagccaggaggttccctcaagaaccacatatgcagaacatcaatggttttccttctcaaatcccatgtcttcctggtgttccttggccttgttcatggactgcaccaatacctccaccagccttgtgccctcctggagttcctttatcattctaccctgcaacatattggagttgcagtgcttcaggttcttggaatattccttgggtcactccacaaccctgtcctccaatccctggtccaaattctccgacgctaggcaagcattcgagagatggcgatgaactccaggctgataattctgagatgaaagatcctccaaaacagaaaaatggatctgttttggttcccaaaactttaaggattgatgatccaaacgaagctgctaagagttcaatatgggagacacttggtattaagaatgattcaatcaaagctgttgatctgtctaatgttttccaatcaaagggcgacctaaagagtaacgtttctgaagtgttgtctccagttttgcaagccaaccctgcagccttgtcaagatctcttactttccacgagcggtcgtgaatggtatttttgattttccaggttcattgtaaaagaaatctttaagttaagaagcttaagcatgaagtggatacaagcatcaatctcaagcttcttctgctcaagaagcaatccagtttttcaagaatcccggaattgttctctctatagaaagagtagctgccattatcaagccatccttttgtacataactttacatatgtgaataaccgatgtagagtggcagctaaagattctcagatgtataaaaatgcagccaaaagtttgcttc

SEQ ID NO: 247 - protein, 380 aa, Cucurbita maxima
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 248 - DNA, 1191 bp, Arabidopsis thaliana
atgtggctctctcatctcttcatgtccctctctaagctgacgtgtaatttctccattttctctgtctttatggcttgtggctctattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatgatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataa

SEQ ID NO: 249 - protein, 396 aa, Arabidopsis thaliana
MWLSHLFMSLSKLTCNFSIFSVFMACGSIGMSQVRDTPVKLFGWTITPVSHDPYSSSSHVLPDSSSSSSSSSLSLRPHMMNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 250 - DNA, 1200 bp, Arabidopsis thaliana
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 251 - protein, 399 aa, Arabidopsis thaliana
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 252 - DNA, 1347 bp, Arabidopsis thaliana
atgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaacgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttag

SEQ ID NO: 253 - protein, 448 aa, Arabidopsis thaliana
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 254 - DNA, 1374 bp, Arabidopsis thaliana
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 255 - protein, 457 aa, Arabidopsis thaliana
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 256 - DNA, 57 bp, Artificial sequence
  primer: prm07303
ggggacaagtttgtacaaaaaagcaggcttaaacaatgatgatggagactagagatc

SEQ ID NO: 257 - DNA, 53 bp, Artificial sequence
  primer: prm07304
ggggaccactttgtacaagaaagctgggtcatatgtaactctaaatctgttca

SEQ ID NO: 258 - DNA, 654 bp, Oryza sativa; identical to SEQ ID NO: 109

SEQ ID NO: 259 - DNA, 1828 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 260 - DNA, 1243 bp, Oryza sativa
aaaaccaccgagggacctgatctgcaccggttttgatagttgagggacccgttgtgtctggttttccgatcgagggacgaaaatcggattcggtgtaaagttaagggacctcagatgaacttattccggagcatgattgggaagggaggacataaggcccatgtcgcatgtgtttggacggtccagatctccagatcactcagcaggatcggccgcgttcgcgtagcacccgcggtttgattcggcttcccgcaaggcggcggccggtggccgtgccgccgtagcttccgccggaagcgagcacgccgccgccgccgacccggctctgcgtttgcaccgccttgcacgcgatacatcgggatagatagctactactctctccgtttcacaatgtaaatcattctactattttccacattcatattgatgttaatgaatatagacatatatatctatttagattcattaacatcaatatgaatgtaggaaatgctagaatgacttacattgtgaattgtgaaatggacgaagtacctacgatggatggatgcaggatcatgaaagaattaatgcaagatcgtatctgccgcatgcaaaatcttactaattgcgctgcatatatgcatgacagcctgcatgcgggcgtgtaagcgtgttcatccattaggaagtaaccttgtcattacttataccagtactacatactatatagtattgatttcatgagcaaatctacaaaactggaaagcaataagaaatacgggactggaaaagactcaacattaatcaccaaatatttcgccttctccagcagaatatatatctctccatcttgatcactgtacacactgacagtgtacgcataaacgcagcagccagcttaactgtcgtctcaccgtcgcacactggccttccatctcaggctagctttctcagccacccatcgtacatgtcaactcggcgcgcgcacaggcacaaattacgtacaaaacgcatgaccaaatcaaaaccaccggagaagaatcgctcccgcgcgcggcggcgacgcgcacgtacgaacgcacgcacgcacgcccaaccccacgacacgatcgcgcgcgacgccggcgacaccggccgtccacccgcgccctcacctcgccgactataaatacgtaggcatctgcttgatcttgtcatccatctcaccaccaaaaaaaaaaggaaaaaaaaacaaaacacaccaagccaaataaaagcgaca

SEQ ID NO: 261 - protein, 8 aa, Artificial sequence
  motif 1
  UNSURE (2)..(3): Xaa can be any naturally occurring amino acid
FXXKYNFD

SEQ ID NO: 262 - protein, 8 aa, Artificial sequence
  motif 2
  VARIANT (1)..(1): Xaa is Leu or Pro
  UNSURE (3)..(3): Xaa can be any naturally occurring amino acid
XLXGRYEW

SEQ ID NO: 263 - protein, 10 aa, Artificial sequence
  motif 3
  UNSURE (2)..(2): Xaa can be any naturally occurring amino acid
  VARIANT (4)..(4): Xaa is Glu or Asp
  UNSURE (7)..(9): Xaa can be any naturally occurring amino acid
EXEXFFXXXE

SEQ ID NO: 264 - protein, 8 aa, Artificial sequence
  motif 4
  UNSURE (2)..(2): Xaa can be any naturally occurring amino acid
YXQLRSRR

SEQ ID NO: 265 - protein, 9 aa, Artificial sequence
  motif 5
  VARIANT (5)..(5): Xaa is Ile or Met
  VARIANT (6)..(6): Xaa is Arg or Lys
  UNSURE (8)..(8): Xaa can be any naturally occurring amino acid
  VARIANT (9)..(9): Xaa is Arg or Lys
MGKYXXKXK

SEQ ID NO: 266 - protein, 8 aa, Artificial sequence
  motif 6
  UNSURE (2)..(2): Xaa can be any naturally occurring amino acid
SXGVRTRA

SEQ ID NO: 267 - DNA, 585 bp, Oryza sativa
atgggcaagtacatgcgcaaggccaaggtggtggtctccggcgaggtggtggccgccgccgtcatggagctcgccgcggcgccgctcggggtgcgcacccgcgcccgctccctcgcgctgcagaagaggcagggcggggagtacctcgagctcaggagccgcaggctcgagaagctccctcctcccccgccgccgccgccgaggaggagggcgacggctgcggctgcgactgctgatgcgacggcgacggagagcgcggaggcggaggtgtcgttcgggggggagaacgtcctcgagctggaggccatggaaaggaataccagggagacgacaccttgcagcttgatcagggaccccgatacgattagcacccctggatctaccacaaggcgcagccactcgagttctcattgcaaggtgcaaacacccgtgcgccacaacattattccagcatcagcagagctggaagcgttcttcgccgccgaagagcaacggcaacgacaggctttcatcgacaagtataactttgatcctgtgaatgactgccctcttcccggccgatttgaatgggtcaagctagactga

SEQ ID NO: 268 - protein, 194 aa, Oryza sativa
MGKYMRKAKVVVSGEVVAAAVMELAAAPLGVRTRARSLALQKRQGGEYLELRSRRLEKLPPPPPPPPRRRATAAAATADATATESAEAEVSFGGENVLELEAMERNTRETTPCSLIRDPDTISTPGSTTRRSHSSSHCKVQTPVRHNIIPASAELEAFFAAEEQRQRQAFIDKYNFDPVNDCPLPGRFEWVKLD

SEQ ID NO: 269 - DNA, 573 bp, Zea mays
atgggcaagtacatgcgcaaggccaaggcttccagcgaggttgtcatcatggatgtcgccgccgctccgctcggagtccgcacccgagcgcgcgccctcgcgctgcagcgtctgcaggagcaacagacgcagtgggaagaaggtgctggcggcgagtacctggagctaaggaaccggaggctcgagaagctgccgccgccgccggcgaccactaggaggtcgggcgggaggaaagcggcagccgaggccgccgcaactaaggaggctgaggcgtcgtacggggagaacatgctcgagttggaggccatggagaggattaccagggagacgacgccttgcagcttgattaacacccagatgactagcactcctgggtccacgagatccagccactcttgccaccgcagggtgaacgctcctccggtgcacgccgtcccaagttctagggagatgaatgagtacttcgctgccgaacagcgacggcaacagcaggatttcattgacaagtacaacttcgatcctgcaaacgactgccctctcccaggcaggtttgagtgggtgaagctagactga

SEQ ID NO: 270 - protein, 190 aa, Zea mays
MGKYMRKAKASSEVVIMDVAAAPLGVRTRARALALQRLQEQQTQWEEGAGGEYLELRNRRLEKLPPPPATTRRSGGRKAAAEAAATKEAEASYGENMLELEAMERITRETTPCSLINTQMTSTPGSTRSGHSCHRRVNAPPVHAVPSSREMNEYFAAEQRRQQQDFIDKYNFDPANDCPLPGRFEWVKLD

SEQ ID NO: 271 - DNA, 755 bp, Triticum aestivum
atgggcaagtacatgcgcaagcccaaggtctccggcgaggtggccgtcatggaggtcgccgccgcgccgctaggggtccgcacccgcgcacgagcgctcgcgatgcagaggcagccgcagggggcggcggtggccaaggaccagggggagtacctggagctcaggagtcggaagctcgagaagctgcccccgccgccgccggcggcgaggaggagggcggccgcggcggagcgtgtcgaggccgaggccgaggccgacgaggtgtccttcggtgagaacgtgctcgagtcggaggccatggggaggggtaccagggagacgacgccctgcagcttgattagggactcgggaacgataagcactcctggatccacaacaagaccgagccactcgaattcccatcgcagggtgcaagctccagcgcgccatattattccatgttcagcagagatgaatgagttcttctctgctgcggagcaaccgcaacagcaagccttcattgacaagtacaactttgatcctgtgaacgactgtcctctcccaggccgatacgagtgggtgaagctagactgataattctccaggaaggagagcaccatgtacttctccgctccctccaccttagcgtcgtggtaaaggccgccccgtcgtgtagctttgtttccgttgtaaaaagaatagttagctgtagtagcctcaatggcgttacatacagagtaatgctgattacacctaatcctcaaaccatgtacgtt

SEQ ID NO: 272 - protein, 190 aa, Triticum aestivum
MGKYMRKPKVSGEVAVMEVAAAPLGVRTRARALAMQRQPQGAAVAKDQGEYLELRSRKLEKLPPPPPAARRRAAAAERVEAEAEADEVSFGENVLESEAMGRGTRETTPCSLIRDSGTISTPGSTTRPSHSNSHRRVQAPARHIIPCSAEMNEFFSAAEQPQQQAFIDKYNFDPVNDCPLPGRYEWVKLD

SEQ ID NO: 273 - DNA, 666 bp, Oryza sativa
atggggaagtacatgcggaaggggaaggtgtcgggggaggtggcggtgatggaggtgggcggggcgctgctcggcgtccgcacccgctcccgcacgctcgcgctgcagcggacgacctcgtcgcagaagccgccggagaagggggagggggaccccggtgcgggcgcgggcgcgggggcggagtacctcgagctcaggagccggaggctcgagaagccgcctccgcacacgccgccggccaaggagaaggagaccgccaggagggcttccgccgccgccgccgccgccgtgaggatgccggcggcgccgcaagcggccgaggagttcgaggcggaggtcgaggtgtccttcggcgacaacgttcttgacctcgacggcgacgccatggagaggagtaccagggagacaacgccttgcagtttaattaggagctcagaaatgataagcacccctggctccacaactaaaaccaacacctcgatcagttcccggcgcagaatggagacctctgtttgtcgttacgttccgagttctcttgagatggaagagttctttgcagctgctgaacaacagcaacatcaggctttcagagagaggtataacttctgtcctgtgaacgactgcccacttcctggacggtacgaatggacaaggctagactgctag

SEQ ID NO: 274 - protein, 221 aa, Oryza sativa
MGKYMRKGKVSGEVAVMEVGGALLGVRTRSRTLALQRTTSSQKPPEKGEGDPGAGAGAGAEYLELRSRRLEKPPPHTPPAKEKETARRASAAAAAAVRMPAAPQAAEEFEAEVEVSFGDNVLDLDGDAMERSTRETTPCSLIRSSEMISTPGSTTKTNTSISSRRRMETSVCRYVPSSLEMEEFFAAAEQQQHQAFRERYNFCPVNDCPLPGRYEWTRLDC

SEQ ID NO: 275 - DNA, 642 bp, Zea mays
atggggaagtacatgcgcaagggcaaggtgtccggggaggtcgccgtcatggaggtacccggcggcgcgctgctcggcgtccgcacccgctcccgcacgctcgcgctgcagcgcgcgcagaggccgctcgacaagggcgacgcggaggacgccgccgcggagtacctcgagctcaggagccggaggctcgagaagccgcacaaggagcatccgtcgccgcccgcgaccgcgaccaagaggggcgccgggaggaaggccgccgccgccgccgcggtgcagcacgtgctgatgcaggacgaggtcgaggtcgaggtctcgttcggggacaacgtgcttgacttggacaccatggaaaggagtaccagagagacaacaccgtgcagcctgattaggaacccagagatgataagcaccccaggatccacaactaaaagcaaaaccagcagcaactcgacgacttcccgccgcagaacggaggaaaccccgagctgccggttcataccgagctcgctcgagatggaggagttcttctcggcggccgagcaacaggagcagcatagcttcagggagaagtacaacttctgtcccgtgaacgactgtcctctccctggccggtacgaatgggcgaggctagactgctag

SEQ ID NO: 276 - protein, 213 aa, Zea mays
MGKYMRKGKVSGEVAVMEVPGGALLGVRTRSRTLALQRAQRPLDKGDAEDAAAEYLELRSRRLEKPHKEHPSPPATATKRGAGRKAAAAAAVQHVLMQDEVEVEVSFGDNVLDLDTMERSTRETTPCSLIRNPEMISTPGSTTKSKTSSNSTTSRRRTEETPSCRFIPSSLEMEEFFSAAEQQEQHSFREKYNFCPVNDCPLPGRYEWARLDC

SEQ ID NO: 277 - DNA, 642 bp, Sorghum bicolor
atggggaagtacatgcgcaagggcaaggtgtccggggaggtcgccgtcatggaggtccccggcggcgcgctgctcggcgtccgcacccgctcccgcacgctcgcgctgcagcgcgcgcagaggccgctcgacaagggcgacgccgaggacgccgctgcggagtacctcgagctcaggagccggaggctcgagaagccgcacaaggacccgttaccgccgccgtctgcgcctgcgaccaagaggggcgccgggaggaaggtcgccaccgccgccgccgccgccgcggcgccgcacgggctggcggaggacgacgtcgaggtctccttcggcgagaacgtgctcgacttcgacgccatggaaaggagtaccagagagacaacaccgtgcagtttgattaggaacccagagatgataagcaccccaggatccacaactaagagtaaaaccagcaactcgatgacctcccgtcgcagaatggaaacctcaatctgccgtttcataccaagttcgcatgagatggaagagttcttctcagcagctgaaaaacaggagcagcaaagcttcagggagaagtataacttctgtcctgtgaacgactgtcctcttccgggtcggtatgaatgggcgaggctagactgctag

SEQ ID NO: 278 - protein, 213 aa, Sorghum bicolor
MGKYMRKGKVSGEVAVMEVPGGALLGVRTRSRTLALQRAQRPLDKGDAEDAAAEYLELRSRRLEKPHKDPLPPPSAPATKRGAGRKVATAAAAAAAPHGLAEDDVEVSFGENVLDFDAMERSTRETTPCSLIRNPEMISTPGSTTKSKTSNSMTSRRRMETSICRFIPSSHEMEEFFSAAEKQEQQSFREKYNFCPVNDCPLPGRYEWARLDC

SEQ ID NO: 279 - DNA, 397 bp, Saccharum officinarum
  misc_feature (342)..(343): n is a, c, g, or t
gtcgacccacgcgtccggtacttcgctgctgaacagcgacgccaacaacaggctttcattgacaagtacaactttgatcctgtaaatgactgccctctcccaggcaggtttgaatgggtgaagctagactgattgattcagaggacaagagagcagcagcatggaactcacctccgctccctccaccaccgcagtgttgtggcagaggcgcataccgtcgtgttagctttgtttctgttgtaaaaacttagtgttagcctgtagccttaattgtcgtgtgttacagtacaaaactgatgctgagttacaacaccctgatctgatctgatccctcaactcagnngtaacccttaacagcttattctgtaaggaaccttacccacccttgttaccagtt

SEQ ID NO: 280 - protein, 37 aa, Saccharum officinarum
YFAAEQRRQQQAFIDKYNFDPVNDCPLPGRFEWVKLD

SEQ ID NO: 281 - DNA, 654 bp, Oryza sativa; identical to SEQ ID NO: 109

SEQ ID NO: 282 - DNA, 1243 bp, Oryza sativa; identical to SEQ ID NO: 260

SEQ ID NO: 283 - DNA, 315 bp, Nicotiana tabacum
ctgccattctttagaggggatgcttgtttaagaacaaaaaatatatcactttcttttgttccaagtcattgcgtatttttttaaaaatatttgttccttcgtatatttcgagcttcaatcactttatggttctttgtattctggctttgctgtaaatcgtagctaaccttcttcctagcagaaattattaatacttgggatatttttttagaatcaagtaaattacatattaccaccacatcgagctgcttttaaattcatattacagccatataggcttgattcattttgcaaaatttccaggatattgacaac

SEQ ID NO: 284 - DNA, 53 bp, Artificial sequence
  primer: prm00472
ggggacaagtttgtacaaaaaagcaggcttcacaatgggcaagtacatgcgca

SEQ ID NO: 285 - DNA, 53 bp, Artificial sequence
  primer: prm00473
ggggaccactttgtacaagaaagctgggtggagcagagaggtccatggtgccc

SEQ ID NO: 286 - protein, 34 aa, Artificial Sequence
  Consensus sequence of the TPR motif
  misc_feature (1)..(3): Xaa is any amino acid
  misc_feature (5)..(6): Xaa is any amino acid
  misc_feature (9)..(10): Xaa is any amino acid
  misc_feature (12)..(19): Xaa is any amino acid
  misc_feature (21)..(23): Xaa is any amino acid
  misc_feature (25)..(26): Xaa is any amino acid
  misc_feature (28)..(31): Xaa is any amino acid
  misc_feature (33)..(34): Xaa is any amino acid
XXXWXXLGXXYXXXXXXXXAXXXFXXAXXXXPXX

SEQ ID NO: 287 - protein, 22 aa, Artificial Sequence
  Leucine zipper motif
  misc_feature (2)..(7): Xaa is any amino acid
  misc_feature (9)..(14): Xaa is any amino acid
  misc_feature (16)..(21): Xaa is any amino acid
LXXXXXXLXXXXXXLXXXXXXL

SEQ ID NO: 288 - protein, 6 aa, Artificial Sequence
  Consensus sequence
  misc_feature (3)..(3): Xaa is any amino acid
  additional amino acids may be inserted between positions 3 and 4
FGXGAP

SEQ ID NO: 289 - protein, 6 aa, Artificial Sequence
  Hexapeptide from the consensus sequence of the FG-GAP domain
PGADGG

SEQ ID NO: 290 - protein, 8 aa, Artificial Sequence
  Consensus Sequence
FAGHETSS

SEQ ID NO: 291 - protein, 6 aa, Artificial Sequence
  Consensus sequence
  misc_feature (1)..(1): Xaa is Ala or Gly
  misc_feature (3)..(3): Xaa is any amino acid
  misc_feature (4)..(4): Xaa is Asp or Glu
  misc_feature (6)..(6): Xaa is Thr or Ser
XGXXTX

SEQ ID NO: 292 - protein, 10 aa, Artificial Sequence
  Consensus sequence
  misc_feature (2)..(3): Xaa is any amino acid
  misc_feature (5)..(5): Xaa is any amino acid
  misc_feature (7)..(7): Xaa is any amino acid
  misc_feature (9)..(9): Xaa is any amino acid
FXXGXRXCXG

SEQ ID NO: 293 - protein, 6 aa, Artificial Sequence
  Consensus sequence
  misc_feature (1)..(1): Xaa is Ala or Gly
  misc_feature (3)..(3): Xaa is any amino acid
  misc_feature (4)..(4): Xaa is Asp or Glu
  misc_feature (6)..(6): Xaa is Thr or Ser
XGXXTX

SEQ ID NO: 294 - protein, 9 aa, Artificial Sequence
  conserved FG-GAP protein domain
FDGYLYLID

SEQ ID NO: 295 - protein, 14 aa, Artificial Sequence
  transition domain
  misc_feature (1)..(2): Xaa is Lys or Arg
  misc_feature (3)..(5): Xaa is any amino acid
  misc_feature (6)..(11): Xaa is any amino acid or no amino acid
XXXXXXXXXXXPPG

SEQ ID NO: 296 - protein, 522 aa, Arabidopsis thaliana
MAFTAFLLLLSSIAAGFLLLLRRTRYRRMGLPPGSLGLPLIGETFQLIGAYKTENPEPFIDERVARYGSVFMTHLFGEPTIFSADPETNRFVLQNEGKLFECSYPASICNLLGKHSLLLMKGSLHKRMHSLTMSFANSSIIKDHLMLDIDRLVRFNLDCNLLGKHSLLLMKGSLHKRMHSLTMSFANSSIIKDHLMLDIDRLVRFNLDSWSSRVLLMEEAKKITFELTVKQLMSFDPGEWSESLRKEYLLVIEGFFSLPLPLFSTTYRKAIQARRKVAEALTVVVMKRREEEEEGAERKKDMLAALLAADDGFSDEEIVDFLVALLVAGYETTSTIMTLAVKFLTETPLALAQLKEEHEKIRAMKSDSYSLEWSDYKSMPFTQCVVNETLRVANIIGGVFRRAMTDVEIKGYKIPKGWKVFSSFRAVHLDPNHFKDARTFNPWRWQSNSVTTGPSNVFTPFGGGPRLCPGYELARVALSVFLHRLVTGFSWVPAEQDKLVFFPTTRTQKRYPIFVKRRDFAT

SEQ ID NO: 297 - protein, 574 aa, Arabidopsis thaliana
MQPPASAGLFRSPENLPWPYNYMDYLVAGFLVLTAGILLRPWLWLRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLATELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 298 - protein, 541 aa, Arabidopsis thaliana
MDTSSSLLFFSFFFFIIIVIFNKINGLRSSPASKKKLNDHHVTSQSHGPKFPHGSLGWPVIGETIEFVSSAYSDRPESFMDKRRLMYGRVFKSHIFGTATIVSTDAEVNRAVLQSDSTAFVPFYPKTVRELMGKSSILLINGSLHRRFHGLVGSFLKSPLLKAQIVRDMHKFLSESMDRELMGKSSILLINGSLHRRFHGLVGSFLKSPLLKAQIVRDMHKFLSESMDLWSEDQPVLLQDVSKTVAFKVLAKALISVEKGEDLEELKREFENFISGLMSLPINFPGTQLHRSLQAKKNMVKQVERIIEGKIRKTKNKEEDDVIAKDVVDVLLKDSSEHLTHNLIANNMIDMMIPGHDSVPVLITLAVKFLSDSPAALNLLTEENMKLKSLKELTGEPLYWNDYLSLPFTQKVITETLRMGNVIIGVMRKAMKDVEIKGYVIPKGWCFLAYLRSVHLDKLYYESPYKFNPWRWQERDMNTSSFSPFGGGQRLCPGLDLARLETSVFLHHLVTRFRWIAEEDTIINFPTVHMKNKLPIWIKRI

SEQ ID NO: 299 - protein, 191 aa, Arabidopsis thaliana
MVRKYRKAKGIVEAGVSSTYMQLRSRRIVYVRSEKSSSVSVVGDNGVSSSCSGSNEYKKKELIHLEEEDKDGDTETSTYRRGTKRKLFENLREEEKEELSKSMENYSSEFESAVKESLDCCCSGRKTMEETVTAEEEEKAKLMTEMPTESEIEDFFVEAEKQLKEKFKKKYNFDFEKEKPLEGRYEWVKLE

SEQ ID NO: 300 - protein, 209 aa, Arabidopsis thaliana
MAAVRRRERDVVEENGVTTTTVKRRKMEEEVDLVESRIILSPCVQATNRGGIVARNSAGASETSVVIVRRRDSPPVEEQCQIEEEDSSVSCCSTSEEKSKRRIEFVDLEENNGDDRETETSWIYDDLNKSEESMNMDSSSVAVEDVESRRRLRKSLHETVKEAELEDFFQVAEKDLRNKLLECSMKYNFDFEKDEPLGGGRYEWVKLNP

SEQ ID NO: 301 - protein, 222 aa, Arabidopsis thaliana
MGKYMKKSKITGDISVMEVSKATAPSPGVRTRAAKTLALKRLNSSAADSALPNDSSCYLQLRSRRLEKPSSLIEPKQPPRVHRSGIKESGSRSRVDSVNSVPVAQSSNEDECFDNFVSVQVSCGENSLGFESRHSTRESTPCNFVEDMEIMVTPGSSTRSMCRATKEYTREQDNVIPTTSEMEEFFAYAEQQQQRLFMEKYNFDIVNDIPLSGRYEWVQVKP

SEQ ID NO: 302 - protein, 286 aa, Arabidopsis thaliana
MGKYIRKSKIDGAGAGAGGGGGGGGGGESSIALMDVVSPSSSSSLGVLTRAKSLALQQQQQRCLLQKPSSPSSLPPTSASPNPPSKQKMKKKQQQMNDCGSYLQLRSRRLQKKPPIVVIRSTKRRKQQRRNETCGRNPNPRSNLDSIRGQNFFDLEEEHTQRTTRESTPCSLIRRPEIMTTPGSSTKLNICVSESNQDGSRSDSVSESVVFGKDKDLISEINKDPTFGREDSLSRSHRRRPTTPEMDEFFSGAEEEQQKQFIEKYNFDPVNEQPLPGRFEWTKVDD

SEQ ID NO: 303 - protein, 189 aa, Arabidopsis thaliana
MGKYIKKSKVAGAVSVKDKSHPPALGFRTRAAAAKNLALHRLRSHSDEADSFNYLQLRSRRLVKLPLLTNTRKQQKQQLIPSVNQCQTKNPRASSGPAKKLEPDTTTEEACGDNERISRSDCNFGDKGFDLESENRSMISDSKSIQSEIEDFFASAEQQQQRFFIQKYNFDIVSDNPLPGRYEWVKVMP

SEQ ID NO: 304 - protein, 196 aa, Arabidopsis thaliana
MSERKRELAEEASSTSFSPLKKTKLNDSSDSSPDSHDVIVFAVSSSSVASSAALASDECSVTIGGEESDQSSSISSGCFTSESKEIAKNSSSFGVDLEDHQIETETETSTFITSNFRKETSPVSEGLGETTTEMESSSATKRKQPGVRKTPTAAEIEDLFSELESQDDKKKQFIEKYNFDIVNDEPLEGRYKWDRL

SEQ ID NO: 305 - protein, 195 aa, Arabidopsis thaliana
MSETKPKRDSEYEGSNIKRMRLDDDDDVLRSPTRTLSSSSSSSLAYSVSDSGGFCSVALSEEEDDHRSSSISSGCSSSETNEIATRLPFSDLEAHEISETEISTLLTNNFRKQGISSSENLGETAEMDSATTEMRDQRKTEKKKKMEKSPTQAELDDFFSAAERYEQKRFTEKYNYDIVNDTPLEGRYQWVSLKP

SEQ ID NO: 306 - protein, 196 aa, Chenopodium rubrum
MAAAATPTSSPAKKIKKVSKSSYNIPQLRSRRKNLSAPENFAELETTPLEVAAVVEEEEVANCSSSEVITTARSDFPPSCCSSNYDQLSSSEPEVVKDDDGLGNRTADPEVESGEASSKQKESHRTEAREATKLDDQDYPATKSTVQIKMPSDSEIEEFFAVAEKDLQKRFSEKYNFDIVKDVPLKGRYDWVPINP

SEQ ID NO: 307 - protein, 225 aa, Oryza sativa
MGKYLRSSCKQQQQPSSPAAVASVAAAAVSSYSYLTLRSGRRVPAAAAAAGGSACRRRHRRGGRRGCAKNGAGSARACGARSPTSSASSGQRRRCEAVECSHGGGRAELSRSPPLGNSVVVVSGDVVSGERKSLKPNSCSREVAAEHAGEHKHNPAAAAAAGRRPPLSPPEAEIEAFFAAAELAERRRFAEKYNYDIALDRPLQGRYEWEPTVPNFDVAKDVTDM

SEQ ID NO: 308 - protein, 157 aa, Glycine max
  misc_feature (96)..(97): Xaa can be any naturally occurring amino acid
MGKYMKKSKIAGDVAAVIMEAPPPHSHLGVRTRAKTLALQNNTTSPDPSAYLQLRSRRLLKLPPTPPENPRRSSARNRRQISALPKPPKTFILSNXXSTEEHITKTKSRCVPTESELEDFFAAAEKDIQKRFTDKYNYDFVKDMPLEGRYEWVKLKS

SEQ ID NO: 309 - protein, 223 aa, Medicago sativa
MGKYMKKLKSKSESPSPNSTPTPSPSPSPTPITTNSPPPTTPNSSDGVRTRARTLALENSNNQNQNLSVSSDSYLQLRNRRLKRPLIRQHSAKRNKGHDGNPKSPIGDSIAEEKTVQKSPEPENAEFKENAEDTERSARETTPVHLIMRADVLRPPRPITRRTFPTEANPKTEQPTIPISREFEEFCAKHEAEQQREFMEKYNFDPVTEQPLPGRYEWEKVSP

SEQ ID NO: 310 - protein, 262 aa, Oryza sativa
MGKYMRKFRGATGEELAAMEVTQVVGVRTRSRSAAAAGATTTKVQAASAASTRRRKALLPTAVVGTTRRDGGSCYLQLRSRMLFMAPPRPAPAARAPVVAEAAGSGNGAAAHAAAGLSRCSSTASSVDAAAQDRSLACRSDVAEAGSEHVPEGSASDSASGRDRERRETTPSSFLPGEVSDLESDLAGGQKRSRPLPSAATASAQQATRPKIPPAAEIEAFFAAAEEAEAKRFAAKYNFDVVRGVPLDAGRFEWTPVVSSRS

SEQ ID NO: 311 - protein, 226 aa, Oryza sativa
  misc_feature (119)..(119): Xaa can be any naturally occurring amino acid
MGKKKKRDGAAARRQARVVVGGVRTRAAVTARRVVASAEEGCGLVGRGGGGGSGGDDGEGGCYLRLRSRRLPFVAAAVVSSRREEALGDSVAEAASSSSSRAVELLGCSGEEEAMAEKXSATTPSSRRPPGDADSSDAESNQEAKQQMCRRSSTTSAAAFHAGATTRSFRMMAPPAAAAEIEEFLAAAERSEAERFAAKYNFDVVRGVPLDAGGAGRFEWTAVGSG

SEQ ID NO: 312 - protein, 216 aa, Zea mays
MGKCVRIRGSSKPRAAAAAAASCLTLCSGRRVPPSEASAACSPRTRSRPRRHRGAGLRRWCGAKESAYGGSPRRHRGEGEADARSPRGRVLGVGARQQQLCADDGLGQQHEEEASATMAGDCDDGAGVAKVNKANKHENDECGCRVVGGVASQTPSPSPSPPPPPTETEIEAFFADAELAERRRFAEAYNYDVALDRPLEGRFEWVPLPLTGGRRW

SEQ ID NO: 313 - protein, 254 aa, Zea mays
MGKYMRKCRGAAGAEVAAVEVTQVVGVRTRSRSAAATGGVAKVAPRRKRAPAGEPAAAVSAGGDGGSCYIHLRSRMLFMAPPQPQPSVPTPAAEAADGAAGQQGAVLAAGLSRCSSTASSVNLGLGGQRGSHTCRSDDAAEAGGDHVLVVDVSASNSGSGPDRERRETTPSSRAHGELSDLESDLAGHKTGPSLPAATPAAELIVPPAHEIQEFFAAAEAAQAKRFASKYNFDFVRGVPLDAGGRFEWAPVVSI

SEQ ID NO: 314 - protein, 538 aa, Artificial Sequence
  Consensus
  misc_feature (2)..(6): Xaa can be any naturally occurring amino acid
  misc_feature (8)..(10): Xaa can be any naturally occurring amino acid
  misc_feature (18)..(38): Xaa can be any naturally occurring amino acid
  misc_feature (41)..(50): Xaa can be any naturally occurring amino acid
  misc_feature (56)..(56): Xaa can be any naturally occurring amino acid
  misc_feature (58)..(58): Xaa can be any naturally occurring amino acid
  misc_feature (74)..(74): Xaa can be any naturally occurring amino acid
  misc_feature (80)..(80): Xaa can be any naturally occurring amino acid
  misc_feature (152)..(152): Xaa can be any naturally occurring amino acid
  misc_feature (165)..(167): Xaa can be any naturally occurring amino acid
  misc_feature (170)..(170): Xaa can be any naturally occurring amino acid
  misc_feature (175)..(175): Xaa can be any naturally occurring amino acid
  misc_feature (183)..(190): Xaa can be any naturally occurring amino acid
  misc_feature (208)..(208): Xaa can be any naturally occurring amino acid
  misc_feature (216)..(217): Xaa can be any naturally occurring amino acid
  misc_feature (221)..(221): Xaa can be any naturally occurring amino acid
  misc_feature (240)..(240): Xaa can be any naturally occurring amino acid
  misc_feature (254)..(254): Xaa can be any naturally occurring amino acid
  misc_feature (258)..(258): Xaa can be any naturally occurring amino acid
  misc_feature (268)..(268): Xaa can be any naturally occurring amino acid
  misc_feature (271)..(277): Xaa can be any naturally occurring amino acid
  misc_feature (279)..(298): Xaa can be any naturally occurring amino acid
  misc_feature (309)..(309): Xaa can be any naturally occurring amino acid
  misc_feature (314)..(314): Xaa can be any naturally occurring amino acid
  misc_feature (318)..(323): Xaa can be any naturally occurring amino acid
  misc_feature (350)..(350): Xaa can be any naturally occurring amino acid
  misc_feature (354)..(354): Xaa can be any naturally occurring amino acid
  misc_feature (358)..(358): Xaa can be any naturally occurring amino acid
  misc_feature (369)..(369): Xaa can be any naturally occurring amino acid
  misc_feature (372)..(373): Xaa can be any naturally occurring amino acid
  misc_feature (376)..(378): Xaa can be any naturally occurring amino acid
  misc_feature (380)..(380): Xaa can be any naturally occurring amino acid
  misc_feature (386)..(386): Xaa can be any naturally occurring amino acid
  misc_feature (388)..(388): Xaa can be any naturally occurring amino acid
  misc_feature (411)..(411): Xaa can be any naturally occurring amino acid
  misc_feature (416)..(416): Xaa can be any naturally occurring amino acid
  misc_feature (424)..(424): Xaa can be any naturally occurring amino acid
  misc_feature (439)..(439): Xaa can be any naturally occurring amino acid
  misc_feature (441)..(441): Xaa can be any naturally occurring amino acid
  misc_feature (444)..(444): Xaa can be any naturally occurring amino acid
  misc_feature (446)..(447): Xaa can be any naturally occurring amino acid
  misc_feature (454)..(480): Xaa can be any naturally occurring amino acid
  misc_feature (511)..(511): Xaa can be any naturally occurring amino acid
  misc_feature (513)..(513): Xaa can be any naturally occurring amino acid
  misc_feature (519)..(519): Xaa can be any naturally occurring amino acid
  misc_feature (522)..(524): Xaa can be any naturally occurring amino acid
SXXXXXLXXXLLALLLIXXXXXXXXXXXXXXXXXXXXXKRXXXXXXXXXXNLPPGXMXGWPFIGETIGYLRPYXATSIGXFMEQHISRYGKIYKSNLFGEPTIVSADAGLNRYILQNEGRLFECSYPRSIGGILGKWSMLVLVGDMHRDMRXISLNFLSSARLRXXXLLXDVEKXTLLVLSWXXXXXXXXFSAQDEAKKFTFNLMAKXIMSMDPGXXETEXLKKEYVTFMKGVVSAPLNXPGTAYRKALKSRSXILKXIERKMEERIXKMXXXXXXXEXXXXXXXXXXXXXXXXXXXXEDDLLGWVLKXSNLSXEQIXXXXXXLDLILSLLFAGHETSSVAIALAIYFLXGCPXAVQXLREEHLEIARXKKXXGEXXXLXWDDYKXMXFTQCVINETLRLGNVVRFLHRKXIKDVXYKGYDIPXGWKVLPVIAAVHLDXSXFDXPXXFNPWRWXXXXXXXXXXXXXXXXXXXXXXXXXXXFMPFGGGPRLCAGSELAKLEMAIFLHHLVLXFXWELAEXDQXXXFPFVDFPKGLPIRV

SEQ ID NO: 315 - protein, 567 aa, Artificial Sequence
  Consensus
  misc_feature (1)..(2): Xaa can be any naturally occurring amino acid
  misc_feature (5)..(14): Xaa can be any naturally occurring amino acid
  misc_feature (16)..(18): Xaa can be any naturally occurring amino acid
  misc_feature (24)..(24): Xaa can be any naturally occurring amino acid
  misc_feature (26)..(26): Xaa can be any naturally occurring amino acid
  misc_feature (31)..(31): Xaa can be any naturally occurring amino acid
  misc_feature (37)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (48)..(48): Xaa can be any naturally occurring amino acid
  misc_feature (50)..(65): Xaa can be any naturally occurring amino acid
  misc_feature (67)..(69): Xaa can be any naturally occurring amino acid
  misc_feature (71)..(76): Xaa can be any naturally occurring amino acid
  misc_feature (78)..(78): Xaa can be any naturally occurring amino acid
  misc_feature (82)..(82): Xaa can be any naturally occurring amino acid
  misc_feature (87)..(87): Xaa can be any naturally occurring amino acid
  misc_feature (95)..(96): Xaa can be any naturally occurring amino acid
  misc_feature (99)..(103): Xaa can be any naturally occurring amino acid
  misc_feature (108)..(110): Xaa can be any naturally occurring amino acid
  misc_feature (113)..(117): Xaa can be any naturally occurring amino acid
  misc_feature (119)..(119): Xaa can be any naturally occurring amino acid
  misc_feature (122)..(124): Xaa can be any naturally occurring amino acid
  misc_feature (128)..(130): Xaa can be any naturally occurring amino acid
  misc_feature (134)..(141): Xaa can be any naturally occurring amino acid
  misc_feature (146)..(146): Xaa can be any naturally occurring amino acid
  misc_feature (149)..(149): Xaa can be any naturally occurring amino acid
  misc_feature (154)..(154): Xaa can be any naturally occurring amino acid
  misc_feature (159)..(159): Xaa can be any naturally occurring amino acid
  misc_feature (161)..(161): Xaa can be any naturally occurring amino acid
  misc_feature (166)..(166): Xaa can be any naturally occurring amino acid
  misc_feature (172)..(177): Xaa can be any naturally occurring amino acid
  misc_feature (179)..(180): Xaa can be any naturally occurring amino acid
  misc_feature (182)..(185): Xaa can be any naturally occurring amino acid
  misc_feature (188)..(188): Xaa can be any naturally occurring amino acid
  misc_feature (190)..(191): Xaa can be any naturally occurring amino acid
  misc_feature (193)..(193): Xaa can be any naturally occurring amino acid
  misc_feature (196)..(196): Xaa can be any naturally occurring amino acid
  misc_feature (198)..(198): Xaa can be any naturally occurring amino acid
  misc_feature (202)..(203): Xaa can be any naturally occurring amino acid
  misc_feature (205)..(206): Xaa can be any naturally occurring amino acid
  misc_feature (208)..(209): Xaa can be any naturally occurring amino acid
  misc_feature (211)..(214): Xaa can be any naturally occurring amino acid
  misc_feature (216)..(216): Xaa can be any naturally occurring amino acid
  misc_feature (220)..(232): Xaa can be any naturally occurring amino acid
  misc_feature (242)..(242): Xaa can be any naturally occurring amino acid
  misc_feature (263)..(263): Xaa can be any naturally occurring amino acid
  misc_feature (267)..(268): Xaa can be any naturally occurring amino acid
  misc_feature (295)..(295): Xaa can be any naturally occurring amino acid
  misc_feature (297)..(297): Xaa can be any naturally occurring amino acid
  misc_feature (301)..(301): Xaa can be any naturally occurring amino acid
  misc_feature (306)..(306): Xaa can be any naturally occurring amino acid
  misc_feature (397)..(397): Xaa can be any naturally occurring amino acid
  misc_feature (400)..(400): Xaa can be any naturally occurring amino acid
  misc_feature (406)..(406): Xaa can be any naturally occurring amino acid
  misc_feature (436)..(437): Xaa can be any naturally occurring amino acid
  misc_feature (441)..(441): Xaa can be any naturally occurring amino acid
  misc_feature (459)..(459): Xaa can be any naturally occurring amino acid
  misc_feature (485)..(485): Xaa can be any naturally occurring amino acid
  misc_feature (489)..(489): Xaa can be any naturally occurring amino acid
  misc_feature (491)..(491): Xaa can be any naturally occurring amino acid
  misc_feature (494)..(495): Xaa can be any naturally occurring amino acid
  misc_feature (509)..(509): Xaa can be any naturally occurring amino acid
  misc_feature (527)..(527): Xaa can be any naturally occurring amino acid
  misc_feature (543)..(543): Xaa can be any naturally occurring amino acid
  misc_feature (549)..(549): Xaa can be any naturally occurring amino acid
XXSAXXXXXXXXXXLXXXSSNLSXFXTPSPXAAQLSXIXPPPLXRNMXAXXXXXXXXXXXXXXXXKXXXNXXXXXXRXKFIXEGGLXKISGRLFXXSGXXXXXRSARXXXDSXXXXXSXIAXXXGNGXXXSSKXXXXXXXXSSKLXSTXLRSVXLRKGXSXATENXDEGSRXXXXXXIXXDXXXXTSXSXXSXDGXSXEQEXXSXXSXXIXXXXSXIAIXXXXXXXXXXXXXISEILALLRXLGEGYRLSCLYKCQEALDVYXKLPXXQYNTGWVLAQVGKAYFELVDYLEADKXFXLARXLSPYXLEGMDIYSTVLYHLKEDMRLSYLAQELISIDRLSPQAWCAVGNCFSLQKDHETALKNFQRAVQLDPRFAYAHTLCGHEYSALEDFENSIKXYRXALRVDXRHYNAWYGLGMVYLRQEKFEFAEHHFRRAXXINPXSSVLMCYLGMALHALKRXEEALEMMEKAIVADKKNPLPKYQKAXILLXLXKYXXALDELEELKEIAPXESSVYALMGKIYKQLNIXDKAVLHFGIALDLKPXAADVAXIKAAMEKLHLPDELMEDD

SEQ ID NO: 316 - protein, 367 aa, Artificial Sequence
  Consensus
  misc_feature (2)..(3): Xaa can be any naturally occurring amino acid
  misc_feature (6)..(46): Xaa can be any naturally occurring amino acid
  misc_feature (48)..(82): Xaa can be any naturally occurring amino acid
  misc_feature (84)..(89): Xaa can be any naturally occurring amino acid
  misc_feature (92)..(109): Xaa can be any naturally occurring amino acid
  misc_feature (112)..(115): Xaa can be any naturally occurring amino acid
  misc_feature (117)..(117): Xaa can be any naturally occurring amino acid
  misc_feature (154)..(154): Xaa can be any naturally occurring amino acid
  misc_feature (159)..(159): Xaa can be any naturally occurring amino acid
  misc_feature (191)..(195): Xaa can be any naturally occurring amino acid
  misc_feature (198)..(201): Xaa can be any naturally occurring amino acid
  misc_feature (225)..(225): Xaa can be any naturally occurring amino acid
  misc_feature (252)..(252): Xaa can be any naturally occurring amino acid
  misc_feature (281)..(293): Xaa can be any naturally occurring amino acid
  misc_feature (297)..(303): Xaa can be any naturally occurring amino acid
  misc_feature (306)..(309): Xaa can be any naturally occurring amino acid
  misc_feature (311)..(317): Xaa can be any naturally occurring amino acid
  misc_feature (319)..(336): Xaa can be any naturally occurring amino acid
  misc_feature (338)..(340): Xaa can be any naturally occurring amino acid
  misc_feature (345)..(350): Xaa can be any naturally occurring amino acid
  misc_feature (352)..(352): Xaa can be any naturally occurring amino acid
  misc_feature (354)..(354): Xaa can be any naturally occurring amino acid
  misc_feature (356)..(359): Xaa can be any naturally occurring amino acid
  misc_feature (361)..(366): Xaa can be any naturally occurring amino acid
LXXPFXXXXXXXXXXXXXXXXXXXXXXXXXXXXXXXXXXXXXXXXXHXXXXXXXXXXXXXXXXXXXXXXXXXXXXXXXXXXXDXXXXXXSGXXXXXXXXXXXXXXXXXXGGXXXXVXRRPRGRPAGSKNKPKPPIIITRDSANALRSHVLEVAXGCDVXESVATFARRRQRGVCVLSGSGTVTNVTLRQPXXXXXAAXXXXGAVVSLHGRFEILSLSGSFLPPPXAPPGATGLTIYLAGGQGQVVGGSVVGXLIASGPVVVMAASFANAAYERLPLEEEEXXXXXXXXXXXXXGGGXXXXXXXGGXXXXAXXXXXXXGXXXXXXXXXXXXXXXXXXLXXXLPPNXXXXXXVXLXGXXXXGXXXXXXG

SEQ ID NO: 317 - protein, 318 aa, Artificial Sequence
  Consensus
  misc_feature (8)..(8): Xaa can be any naturally occurring amino acid
  misc_feature (10)..(10): Xaa can be any naturally occurring amino acid
  misc_feature (13)..(31): Xaa can be any naturally occurring amino acid
  misc_feature (34)..(34): Xaa can be any naturally occurring amino acid
  misc_feature (38)..(43): Xaa can be any naturally occurring amino acid
  misc_feature (45)..(45): Xaa can be any naturally occurring amino acid
  misc_feature (58)..(102): Xaa can be any naturally occurring amino acid
  misc_feature (105)..(105): Xaa can be any naturally occurring amino acid
  misc_feature (112)..(112): Xaa can be any naturally occurring amino acid
  misc_feature (114)..(149): Xaa can be any naturally occurring amino acid
  misc_feature (151)..(152): Xaa can be any naturally occurring amino acid
  misc_feature (154)..(156): Xaa can be any naturally occurring amino acid
  misc_feature (160)..(204): Xaa can be any naturally occurring amino acid
  misc_feature (206)..(206): Xaa can be any naturally occurring amino acid
  misc_feature (208)..(211): Xaa can be any naturally occurring amino acid
  misc_feature (213)..(213): Xaa can be any naturally occurring amino acid
  misc_feature (215)..(216): Xaa can be any naturally occurring amino acid
  misc_feature (222)..(222): Xaa can be any naturally occurring amino acid
  misc_feature (224)..(224): Xaa can be any naturally occurring amino acid
  misc_feature (226)..(228): Xaa can be any naturally occurring amino acid
  misc_feature (230)..(230): Xaa can be any naturally occurring amino acid
  misc_feature (234)..(235): Xaa can be any naturally occurring amino acid
  misc_feature (238)..(238): Xaa can be any naturally occurring amino acid
  misc_feature (240)..(266): Xaa can be any naturally occurring amino acid
  misc_feature (282)..(284): Xaa can be any naturally occurring amino acid
  misc_feature (288)..(290): Xaa can be any naturally occurring amino acid
  misc_feature (292)..(292): Xaa can be any naturally occurring amino acid
  misc_feature (299)..(299): Xaa can be any naturally occurring amino acid
  misc_feature (301)..(301): Xaa can be any naturally occurring amino acid
  misc_feature (303)..(303): Xaa can be any naturally occurring amino acid
  misc_feature (306)..(310): Xaa can be any naturally occurring amino acid
MGKYMRKXKXSGXXXXXXXXXXXXXXXXXXXVAXMEVXXXXXXSXLGVRTRARTLALXXXXXXXXXXXXXXXXXXXXXXXXXXXXXXXXXXXXXXXXXXXXXYLXLRSRRLXKXXXXXXXXXXXXXXXXXXXXXXXXXXXXXXXXXXXXGXXSXXXAASXXXXXXXXXXXXXXXXXXXXXXXXXXXXXXXXXXXXXXXXXXXXXDXEXXXXEXRXXRETTPXSXIXXXEXISTXXSTXRXXXXXXXXXXXXXXXXXXXXXXXXXXXIPTSAEIEEFFAAAEXXXQKRXXXFXEKYNFDXVXDXPLXXXXXGRYEWVKL

The invention claimed is:

1. A method for increasing yield of a plant relative to a corresponding control plant, comprising:
    a) increasing expression in a plant of a nucleic acid encoding an FG-GAP polypeptide by introducing and expressing in a plant a nucleic acid comprising:
        i) the nucleic acid sequence of SEQ ID NO: 45,
        ii) a nucleic acid sequence encoding a polypeptide comprising the amino acid sequence of SEQ ID NO: 46, or
        iii) a nucleic acid sequence encoding an FG-GAP polypeptide which comprises an amino acid sequence having at least 95% sequence identity to the amino acid sequence of SEQ ID NO: 46; and
    b) selecting a plant having increased yield relative to a corresponding control plant on the basis of said plant showing increased yield relative to said control plant.

2. The method of claim 1, wherein the nucleic acid comprises a sequence capable of hybridising to the nucleic acid sequence of SEQ ID NO: 45 under stringent hybridization conditions comprising hybridization at 65° C. or 42° C. in 1×SSC and 50% formamide followed by one or more washes in 0.3×SSC at 65° C. and encodes an FG-GAP polypeptide comprising a signal peptide, one or more FG-GAP domains, and a transmembrane domain located in the C-terminal half of the polypeptide.

3. The method of claim 1, wherein said nucleic acid encodes an FG-GAP polypeptide comprising one or more of the conserved motifs of SEQ ID NO: 50, SEQ ID NO: 51 and SEQ ID NO: 52.

4. The method of claim 1, wherein said nucleic acid is overexpressed in said plant.

5. The method of claim 1, wherein said nucleic acid is of plant origin, from a dicotyledonous plant, from the family Brassicaceae, or from *Arabidopsis thaliana*.

6. The method of claim 1, wherein said nucleic acid is operably linked to a constitutive promoter.

7. The method of claim 6, wherein the constitutive promoter is a GOS2 promoter.

8. The method of claim 1, wherein the increased yield is increased seed yield.

9. The method of claim 8, wherein the increased seed yield is selected from the group consisting of increased total weight of seeds, increased number of filled seeds, and increased harvest index.

10. A plant, plant part, or plant cell obtained by the method of claim 1, or a progeny of said plant, wherein the plant, plant part, or plant cell, or said progeny, comprises said nucleic acid operably linked to a constitutive promoter, and wherein said progeny has increased yield relative to a corresponding control plant on the basis of said progeny showing increased yield relative to said control plant.

11. A method for the production of a transgenic plant having increased yield compared to a corresponding wild type plant, comprising:
    (a) introducing and expressing in a plant or plant cell a nucleic acid encoding an FG-GAP polypeptide, wherein said nucleic acid comprises:
        i) the nucleic acid sequence of SEQ ID NO: 45,
        ii) a nucleic acid sequence encoding a polypeptide comprising the amino acid sequence of SEQ ID NO: 46, or
        iii) a nucleic acid sequence encoding an FG-GAP polypeptide which comprises an amino acid sequence having at least 95% sequence identity to the amino acid sequence of SEQ ID NO: 46;
    (b) selecting a plant having increased yield relative to a corresponding control plant on the basis of said plant showing increased yield relative to said control plant;
    (c) cultivating the plant under conditions promoting plant growth and development; and
    (d) optionally obtaining a progeny of said plant having increased yield, wherein said progeny has increased yield relative to a corresponding control plant.

12. The plant, plant part, or plant cell of claim 10, wherein the plant is a monocotyledonous plant, sugarcane, a cereal, rice, maize, wheat, barley, millet, rye, oats or sorghum, or wherein said plant part or plant cell is derived from a monocotyledonous plant, sugarcane, a cereal, rice, maize, wheat, barley, millet, rye, oats or sorghum.

13. Harvestable parts of the plant of claim 10, wherein the harvestable parts comprise said nucleic acid operably linked to a constitutive promoter.

14. The harvestable parts of claim 13, wherein said harvestable parts are seeds.

15. A method for increasing yield of a plant relative to a corresponding control plant comprising transforming a plant or plant cell with a construct comprising:
(a) a nucleic acid comprising:
(i) the nucleic acid sequence of SEQ ID NO: 45,
(ii) a nucleic acid sequence encoding a polypeptide comprising the amino acid sequence of SEQ ID NO: 46; or
(iii) a nucleic acid sequence encoding an FG-GAP polypeptide which comprises an amino acid sequence having at least 95% sequence identity to the amino acid sequence of SEQ ID NO: 46;
(b) one or more control se s uences ca s able of drivin ex ression of the nucleic acid of (a); and optionally
(c) a transcription termination sequence,
and selecting a plant having increased yield relative to a corresponding control plant on the basis of said plant showing increased yield relative to said control plant.

16. The method of claim 15, wherein the increased yield is increased total weight of seeds, increased number of filled seeds, or increased harvest index.

17. The method of claim 1, comprising utilizing said nucleic acid or, the FG-GAP polypeptide encoded by said nucleic acid as a molecular marker.

18. A plant, plant part, or plant cell obtained by the method of claim 11, or a progeny of said plant, wherein the plant, plant part, or plant cell, or said progeny, comprises said nucleic acid, and wherein said progeny has increased yield relative to a corresponding control plant.

19. The plant, plant part, or plant cell of claim 18, wherein the plant is a monocotyledonous plant, sugarcane, a cereal, rice, maize, wheat, barley, millet, rye, oats or sorghum, or wherein said plant part or plant cell is derived from a monocotyledonous plant, sugarcane, a cereal, rice, maize, wheat, barley, millet, rye, oats or sorghum.

20. Harvestable parts of the plant of claim 18, wherein the harvestable parts comprise said nucleic acid.

21. The harvestable parts of claim 20, wherein said harvestable parts are seeds.

22. A plant, plant part, or plant cell obtained by the method of claim 15, or a progeny of said plant, wherein the plant, plant part, or plant cell, or said progeny, comprises said nucleic acid, and wherein said progeny has increased yield relative to a corresponding control plant.

23. The plant, plant part, or plant cell of claim 22, wherein the plant is a monocotyledonous plant, sugarcane, a cereal, rice, maize, wheat, barley, millet, rye, oats or sorghum, or wherein said plant part or plant cell is derived from a monocotyledonous plant, sugarcane, a cereal, rice, maize, wheat, barley, millet, rye, oats or sorghum.

24. Harvestable parts of the plant of claim 22, wherein the harvestable parts comprise said nucleic acid.

25. The harvestable parts of claim 24, wherein said harvestable parts are seeds.

* * * * *

UNITED STATES PATENT AND TRADEMARK OFFICE
CERTIFICATE OF CORRECTION

PATENT NO. : 8,487,160 B2  Page 1 of 1
APPLICATION NO. : 12/095512
DATED : July 16, 2013
INVENTOR(S) : Frankard et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1286 days.

Signed and Sealed this
Eighth Day of September, 2015

Michelle K. Lee
*Director of the United States Patent and Trademark Office*